US011702646B2

(12) United States Patent
Bhattacharyya et al.

(10) Patent No.: US 11,702,646 B2
(45) Date of Patent: Jul. 18, 2023

(54) METHODS FOR MODULATING RNA SPLICING

(71) Applicant: PTC THERAPEUTICS, INC., South Plainfield, NJ (US)

(72) Inventors: Anuradha Bhattacharyya, Edison, NJ (US); Amal Dakka, Whitehouse Station, NJ (US); Kerstin Effenberger, Metuchen, NJ (US); Vijayalakshmi Gabbeta, Bridgewater, NJ (US); Wencheng Li, Bedminster, NJ (US); Nikolai Naryshkin, East Brunswick, NJ (US); Christopher Trotta, Somerset, NJ (US); Kari Wiedinger, New Providence, NJ (US)

(73) Assignee: PTC THERAPEUTICS, INC., South Plainfield, NJ (US)

( * ) Notice: Subject to any disclaimer, the term of this patent is extended or adjusted under 35 U.S.C. 154(b) by 1024 days.

(21) Appl. No.: 16/463,775

(22) PCT Filed: Nov. 27, 2017

(86) PCT No.: PCT/US2017/063323
§ 371 (c)(1),
(2) Date: May 23, 2019

(87) PCT Pub. No.: WO2018/098446
PCT Pub. Date: May 31, 2018

(65) Prior Publication Data
US 2019/0330615 A1    Oct. 31, 2019

Related U.S. Application Data

(60) Provisional application No. 62/426,619, filed on Nov. 28, 2016.

(51) Int. Cl.
*C07H 21/04*   (2006.01)
*C12N 15/10*   (2006.01)
*C07C 255/00*  (2006.01)
*C07C 291/00*  (2006.01)

(52) U.S. Cl.
CPC ............ *C12N 15/10* (2013.01); *C07C 255/00* (2013.01); *C07C 291/00* (2013.01); *C12N 15/102* (2013.01)

(58) Field of Classification Search
None
See application file for complete search history.

(56) References Cited

U.S. PATENT DOCUMENTS

| 3,558,618 A | 1/1971 | Trepanier et al. |
| 4,122,274 A | 10/1978 | Juby |
| 4,342,870 A | 8/1982 | Kennis et al. |
| 5,089,633 A | 2/1992 | Powers et al. |
| 5,599,816 A | 2/1997 | Chu et al. |
| 6,630,488 B1 | 10/2003 | Lamothe et al. |
| 6,977,255 B2 | 12/2005 | Robertson et al. |
| 7,326,711 B2 | 2/2008 | Wang et al. |
| 7,399,767 B2 | 7/2008 | Zhang et al. |
| 7,563,601 B1 | 7/2009 | Gaur et al. |
| 7,569,337 B2 | 8/2009 | Auberson |
| 7,897,792 B2 | 3/2011 | Iikura et al. |
| 8,337,941 B2 | 12/2012 | Gubernator et al. |
| 8,633,019 B2 | 1/2014 | Paushkin et al. |
| 8,962,842 B2 | 2/2015 | Roussel et al. |
| 9,371,336 B2 | 6/2016 | Lee et al. |
| 9,399,649 B2 | 6/2016 | Chen et al. |
| 9,586,955 B2 | 3/2017 | Qi et al. |
| 9,617,268 B2 | 4/2017 | Woll et al. |
| 9,879,007 B2 | 1/2018 | Qi et al. |

(Continued)

FOREIGN PATENT DOCUMENTS

| EP | 1227084 A1 | 6/1998 |
| JP | 1981-150091 | 3/1983 |

(Continued)

OTHER PUBLICATIONS

Coady et al., 2010, "Trans-splicing-mediated improvement in a severe mouse model of spinal muscular atrophy," J Neurosci., vol. 30(1), pp. 126-130.
European Patent Office, Communication pursuant to Article 94(3) Epc dated Mar. 23, 2018 in Application No. 14877918.4.
Falaleeva et al., 2016, "Dual function of C/D box small nucleolar RNAs in rRNA modification and alternative pre-mRNA splicing." Proc Natl Acad Sci U S A. 113(12):E1625-34.
Greene et al., 1991, Protective Groups in Organic Synthesis (1991), Chapter 1, p. 1-16; Wiley, New York.

(Continued)

*Primary Examiner* — Kimberly Chong
(74) *Attorney, Agent, or Firm* — Jones Day

(57) ABSTRACT

In one aspect, described herein is an intronic recognition element for splicing modifier (iREMS) that can be recognized by a compound provided herein. In another aspect, described herein are methods for modulating the amount of a product of a gene, wherein a precursor RNA transcript transcribed from the gene contains an intronic REMS, and the methods utilizing a compound described herein. More particularly, described herein are methods for modulating the amount of an RNA transcript or protein product encoded by a gene, wherein a precursor RNA transcript transcribed from the gene comprises an intronic REMS, and the methods utilizing a compound described herein. In another aspect, provided herein are artificial gene constructs comprising an intronic REMS, and uses of those artificial gene constructs to modulate protein production. In another aspect, provided herein are methods for altering endogenous genes to comprise an intronic REMS, and the use of a compound described herein to modulate protein produced from such altered endogenous genes.

9 Claims, 7 Drawing Sheets

Specification includes a Sequence Listing.

(56) References Cited

U.S. PATENT DOCUMENTS

| | | | |
|---|---|---|---|
| 9,969,754 | B2 | 5/2018 | Ratni et al. |
| 10,195,202 | B2 | 2/2019 | Naryshkin |
| 10,208,067 | B2 | 2/2019 | Gillespie et al. |
| 10,668,171 | B2 | 6/2020 | Naryshkin et al. |
| 2002/0110543 | A1 | 8/2002 | Chiocca et al. |
| 2003/0199526 | A1 | 10/2003 | Choquette et al. |
| 2005/0048549 | A1 | 3/2005 | Cao et al. |
| 2007/0087366 | A1 | 4/2007 | Holt et al. |
| 2008/0255162 | A1 | 10/2008 | Bruendl et al. |
| 2009/0170793 | A1 | 7/2009 | Gaur et al. |
| 2009/0305900 | A1 | 12/2009 | Belouchi et al. |
| 2010/0303776 | A1 | 12/2010 | Samulski et al. |
| 2013/0245035 | A1 | 9/2013 | Roussel et al. |
| 2014/0206661 | A1 | 7/2014 | Axford et al. |
| 2014/0249210 | A1 | 9/2014 | Lutz et al. |
| 2015/0005289 | A1 | 1/2015 | Qi et al. |
| 2015/0119380 | A1 | 4/2015 | Woll et al. |
| 2015/0080383 | A1 | 5/2015 | Yang et al. |
| 2017/0000794 | A1 | 1/2017 | Naryshkin et al. |
| 2017/0001995 | A1* | 1/2017 | Metzger ............... A61K 31/506 |
| 2018/0161456 | A1 | 6/2018 | Naryshkin et al. |
| 2019/0134045 | A1 | 5/2019 | Naryshkin |
| 2020/0370043 | A1 | 11/2020 | Bhattacharyya et al. |
| 2021/0069350 | A1 | 3/2021 | Naryshkin et al. |

FOREIGN PATENT DOCUMENTS

| | | |
|---|---|---|
| WO | WO 1993/23398 | 11/1993 |
| WO | WO1996039407 | 12/1996 |
| WO | WO 1998/025930 | 6/1998 |
| WO | WO2002087589 | 11/2002 |
| WO | WO 2004/009558 | 1/2004 |
| WO | WO2004113335 | 12/2004 |
| WO | WO2005105801 | 11/2005 |
| WO | WO 2008/077188 A1 | 7/2008 |
| WO | WO 2009/151546 | 5/2009 |
| WO | WO 2010/19236 | 8/2009 |
| WO | WO 2007/109211 | 9/2009 |
| WO | WO 2009/156861 | 12/2009 |
| WO | WO 2010/000032 A1 | 1/2010 |
| WO | WO 2011/050245 | 4/2011 |
| WO | WO 2011/62853 | 5/2011 |
| WO | WO 2011/85990 | 7/2011 |
| WO | WO 2013/059606 | 4/2013 |
| WO | WO 2013/101974 | 7/2013 |
| WO | WO 2013/112788 | 8/2013 |
| WO | WO 2013/119916 | 8/2013 |
| WO | WO 2013/130689 | 9/2013 |
| WO | WO 2013/142236 | 9/2013 |
| WO | WO 2014/012050 A2 | 1/2014 |
| WO | WO 2015/024876 A2 | 2/2015 |
| WO | WO 2015/095446 | 6/2015 |
| WO | WO 2015/095449 | 6/2015 |
| WO | WO 2015/105657 | 7/2015 |
| WO | WO 2015/173181 | 11/2015 |
| WO | WO 2016/042015 | 3/2016 |
| WO | WO 2016/128343 | 8/2016 |
| WO | WO 2016/196386 | 12/2016 |
| WO | WO 2018/098446 | 5/2018 |
| WO | WO 2018/232039 | 12/2018 |
| WO | WO 2019/028440 | 2/2019 |
| WO | WO 2019/060917 | 3/2019 |

OTHER PUBLICATIONS

Hernández-Imaz et al., "Functional Analysis of Mutations in Exon 9 of NF1 Reveals the Presence of Several Elements Regulating Splicing," Plos One, Oct. 28, 2015;10(10):e0141735.

Higuchi and W. Stella, 1987, "Pro-drugs as Novel Delivery Systems," vol. 14 of the A.C.S. Symposium Series, and in Bioreversible Carriers in Drug Design, ed. Edward B. Roche, American Pharmaceutical Association and Pergamon Press.

Hua et al., 2012, "Peripheral SMN restoration is essential for long-term rescue of a severe SMA mouse model," Nature, vol. 478(7367): pp. 123-126.

Jarecki et al., 2005, "Diverse small-molecule modulators of SMN expression found by high throughput compound screening: early leads towards a therapeutic for spinal muscular atrophy," Human Molecular Genetics, 14(14):2003-2018 (2005).

Knight et al., 2004, "Isoform-specific phosphoinositide 3-kinase inhibitors from an arylmorpholine scaffold," Bioorganic & Medicinal Chemistry, 12:4749-4759.

Kocar et al., 2002, "Transformations of 3-aminopyridazines. Synthesis of 4-oxo-4H-pyrimido[1,2-b]pyridazine and 1-(substituted pyridazin-3-yi)-1H-1,2,3-triazole derivatives," ARKIVOC 2002 (viii) 143-156.

Le et al., 2005, "SMND7, the major product of the centromeric survival motor neuron (SMN2) gene, extends survival in mice with spinal muscular atrophy and associates with full-length SMN," Human Molecular Genetics, vol. 14(6) pp. 845-857.

Liu et al., 1996, "A novel nuclear structure containing the survival of motor neurons protein," EMBO J., vol. 15(14), pp. 3555-3565.

Makhortova, et al. 2011, "A Screen for Regulators of Survival of Motor Neuron Protein Levels," Nat Chern Bioi, 7(8):544-552.

Naryshkin et al., 2014, "SMN2 splicing modifiers improve motor function and longevity in mice with spinal muscular atrophy," Science, 345(6197): 688-693 (including supplementary materials).

Palacino, et al., 2015, "SMN2 splice modulators enhance U1-pre-mRNA association and rescue SMA mice," Nature chemical biology, 11(7): 511-517 (including supplementary materials).

Passini et al., 2001, "Antisense Oligonucleotides Delivered to the Mouse CNS Ameliorate Symptoms of Severe Spinal Muscular Atrophy," Sci Transl Med., vol. 3(72) (21 pages).

Peng et al., 2011, "Identification of pyrido [1, 2-α] pyrimidine-4-ones as new molecules improving the transcriptional functions of estrogen-related receptor α", Journal of medicinal chemistry, 54 (21) : 7729-7733.

Pinard et al., 2017, "Discovery of a Novel Class of Survival Motor Neuron 2 Splicing Modifiers for the Treatment of Spinal Muscular Atrophy." J Med Chem. 60(10):4444-4457.

PubChem compound Cid 377422. Mar. 26, 2005. Retrieved from the Internet Oct. 27 2014: <http://pubchem.ncbi.nlm.nih.gov// compound/377422?from=summary>) (13 pages).

Ratni et al., 2016, "Specific Correction of Alternative Survival Motor Neuron 2 Splicing by Small Molecules: Discovery of a Potential Novel Medicine to Treat Spinal Muscular Atrophy." J Med Chem. 59(13):6086-100.

Singh et al., 2007, "Modulating role of RNA structure in alternative splicing of a critical exon in the spinal muscular atrophy genes", Nucleic Acids Research, 35(2):371-389.

Sivaramakrishnan et al., 2017, "Binding to SMN2 pre-mRNA-protein complex elicits specificity for small molecule splicing modifiers", Nature Communications, 8(1476):1-13 (including supplementary material).

Zhao et al., 2016, "Pharmacokinetics, pharmacodynamics, and efficacy of a small-molecule SMN2 splicing modifier in mouse models of spinal muscular atrophy." Hum Mol Genet. 25(10):1885-1899.

Restriction Requirement dated Feb. 4, 2019 in U.S. Appl. No. 15/577,584 (9 pages).

Response to Restriction Requirement filed May 6, 2019 in U.S. Appl. No. 15/577,584 (8 pages).

Non-final Rejection dated Jun. 5, 2019 in U.S. Appl. No. 15/577,584 (9 pages).

Response to Non-final Rejection filed Sep. 3, 2019 in U.S. Appl. No. 15/577,584 (11 pages).

Written Opinion of the International Searching Authority dated Aug. 30, 2013 in PCT/US2013/025292 (6 pages).

Written Opinion of the International Searching Authority dated Apr. 13, 2018 in PCT/US2017/063323 (9 pages).

Written Opinion of the International Searching Authority dated Nov. 15, 2016 in PCT/US2016/034864 (9 pages).

Written Opinion of the International Searching Authority dated Sep. 17, 2018 in PCT/US2018/037412 (4 pages).

Supplementary European Search Report dated Nov. 2, 2018 in European Application No. 16804178 (3 pages).

(56) References Cited

OTHER PUBLICATIONS

International Preliminary Report dated Aug. 12, 2014 in PCT/US2013/025292 (7 pages).
International Preliminary Report dated May 28, 2019 in PCT/US2017/063323 (10 pages).
International Preliminary Report dated Nov. 27, 2017 in PCT/US2016/034864 (94 pages).
International Search Report dated Oct. 24, 2013 in PCT/US2013/025292 (6 pages).
International Search Report dated Apr. 13, 2018 in PCT/US2017/063323 (7 pages).
International Search Report dated Aug. 30, 2013 in PCT/US2013/025292 (6 pages).
International Search Report dated Nov. 15, 2016 in PCT/US2016/034864 (6 pages).
International Search Report dated Sep. 17, 2018 in PCT/US2018/037412 (4 pages).
Final Office Action dated Sep. 24, 2019 in U.S. Appl. No. 15/577,584 (12 pages).
Response to Final Office Action filed Dec. 20, 2019 in U.S. Appl. No. 15/577,584 (7 pages).
Notice of Allowance dated Jan. 15, 2020 in U.S. Appl. No. 15/577,584 (5 pages).
Supplementary Partial European Search Report and Provisional Opinion Accompanying the Partial Search Result dated Jun. 25, 2020 in European Patent Application No. 17873550.2 (21 pages).
Supplementary European Search Report dated Feb. 4, 2021 in European Application No. 18817883 (with communication) (9 pages).
Response to Communication pursuant to Rules 70(2) and 70a(2) filed Sep. 3, 2021 in EP Application No. 18817883 (8 pages).
Mercer et al. 2015, "Genome-wide discovery of human splicing branchpoints." Genome Res. 25(2):290-303.
Yuo et al., 2008, "5-(N-ethyl-N-isopropyl)-amiloride enhances SMN2 exon 7 inclusion and protein expression in spinal muscular atrophy cells," Annals of neurology 63.1 (2008): 26-34.
Shao et al., 2012, "Synthesis and structure-activity relationship (SAR) study of 4-azabenzoxazole analogues as H3 antagonists," Bioorganic & medicinal chemistry letters 22.5 (2012): 2075-2078.
Calder et al., 2016, "Small Molecules in Development for the Treatment of Spinal Muscular Atrophy," Journal of Medicinal Chemistry, 59(22):10067-10083.
Cheung et al., 2018, "Discovery of Small Molecule Splicing Modulators of Survival Motor Neuron-2 (SMN2) for the Treatment of Spinal Muscular Atrophy (SMA)," Journal of Medicinal Chemistry, 61(24):11021-11036.

\* cited by examiner

METHODS FOR MODULATING RNA SPLICING

CROSS-REFERENCE TO RELATED APPLICATIONS

This application is a U.S. National Stage Application of International Patent Application No. PCT/US2017/063323, filed Nov. 27, 2017, which claims the benefit of U.S. provisional application No. 62/426,619, filed Nov. 28, 2016, each of which is incorporated by reference herein in its entirety.

REFERENCE TO SEQUENCE LISTING SUBMITTED ELECTRONICALLY

This application incorporates by reference a Sequence Listing submitted with this application as a text file entitled "10589-275-228_Sequence_Listing.txt" created on Nov. 18, 2017 and having a size of 1,112 kilobytes.

INTRODUCTION

In one aspect, described herein is a recognition element for splicing modifier (REMS) present in an intron (i.e., an "intronic REMS" or iREMS) that can be recognized as a 5' splice site by the U1 snRNP and/or other components of the pre-mRNA splicing machinery in the presence of a small molecule splicing modifier, wherein gene expression is modulated by inducing alternative splicing of intronic exons (iExons) in the transcribed RNA. In another aspect, described herein are methods for modulating the amount of a product of a gene, wherein a precursor RNA transcript transcribed from the gene contains an intronic REMS, a branch point and a 3' splice site, and the methods utilize a small molecule compound described herein to induce alternative splicing of iExons. More particularly, described herein are methods for modulating the amount of an RNA transcript or protein product encoded by a gene via alternative splicing of iExons, wherein a precursor RNA transcript transcribed from the gene comprises an endogenous or non-endogenous intronic REMS, and the methods utilize a compound described herein to induce iExon alternative splicing. In another aspect, provided herein are artificial gene constructs comprising an intronic REMS (including an endogenous or non-endogenous intronic REMS), and uses of those artificial gene constructs to modulate protein production via iExon alternative splicing in the presence of a small molecule splicing modifier compound. In another aspect, provided herein are methods for altering genes to comprise an endogenous or non-endogenous intronic REMS, and the use of a small molecule compound described herein to induce alternative splicing of iExons, subsequently modulating the amount and type of protein produced from such altered endogenous or non-endogenous gene transcripts.

BACKGROUND

Diseases associated with expression of an aberrant gene product (e.g., where the production of an aberrant RNA transcript or protein causes a disease) are often treated with a focus on affecting aberrant protein expression. However, targeting components of the splicing process responsible for production of aberrant RNA before the aberrant protein is expressed by using a small molecule may affect the underlying cause of a disease or disorder, and thus more efficiently prevent or ameliorate the disease or disorder caused by expression of the aberrant gene product. Accordingly, there is a need for methods of modulating the expression of aberrant RNA transcripts encoded by certain genes using small molecules to prevent or treat diseases associated with expression of aberrant RNA transcripts or associated proteins.

SUMMARY

In one aspect, provided herein is a recognition element for splicing modifier (otherwise referred to as "REMS") present in an intron (i.e., an "intronic REMS") capable of being recognized by the U1 snRNP and/or other components of the pre-mRNA splicing machinery in the presence of a small molecule splicing modifier, whereby elements of the splicing reaction are affected as further described herein. In a specific embodiment, the intronic REMS comprises the nucleotide sequence GAgurngn (SEQ ID NO: 2) at the RNA level, wherein r is A or G (i.e., a purine nucleotide adenine or guanine) and n is any nucleotide. In another specific embodiment, the intronic REMS comprises the nucleotide sequence GAguragu (SEQ ID NO: 3866) at the RNA level, wherein r is adenine or guanine. In a specific embodiment, the intronic REMS comprises the nucleotide sequence NNGAgurngn (SEQ ID NO: 1) at the RNA level, wherein r is A or G (i.e., a purine nucleotide adenine or guanine) and n or N is any nucleotide. In another specific embodiment, the intronic REMS comprises the nucleotide sequence NNGAguragu (SEQ ID NO: 3862) at the RNA level, wherein r is adenine or guanine and N is any nucleotide. In one or more of such specific embodiments provided herein, N is adenine or guanine.

In another aspect, in addition to the intronic REMS sequence, the RNA transcript comprises an upstream branch point and a functional upstream iExon 3' splice site. In certain embodiments including, but not limited to, iExons, an exon 5' splice site, a branch point and the functional iExon 3' splice site upstream from the intronic REMS are further linked to a downstream branch point and 3' splice site of a downstream exon (see, for example, FIG. 1A). In other embodiments including, but not limited to, extended exons, the branch point and the functional 3' splice site for an exon are downstream from the intronic REMS sequences (see, for example, FIGS. 1B and 1C). In a particular embodiment, an RNA sequence comprises two exons and an intron, wherein one exon is upstream of the intron and the other exon is downstream of the intron, and wherein the intron comprises in 5' to 3' order: a first 5' splice site, a first branch point, a first 3' splice site (also referred to as an iExon 3' splice site), an iREMS, a second branch point, and a second 3' splice site. In the presence of a compound described herein, the iREMS sequence functions as a 5' splice site, causing the NNGA (SEQ ID NO: 3863) nucleotides of the iREMS and the intronic nucleotides downstream of the first 3' splice site to be retained and spliced as an intronic exon to provide a non-wild-type mRNA. In other words, the nucleotides between the iREMS and the first 3' splice site are retained and form the intronic exon, which results in the expression of a non-wild-type mRNA sequence. In the presence of a compound described herein, the iREMS sequence functions as a 5' splice site, causing the NNGA (SEQ ID NO: 3863) nucleotides of the iREMS and the intronic nucleotides between the 3' iExon splice site to be retained and spliced as an intronic exon to provide a non-wild-type mRNA. In other aspects, in the presence of a compound described herein and a downstream branch point, the intronic REMS will undergo splicing with the 3' splice site of a downstream exon. In this aspect, the intronic REMS is located downstream of an exon such that there is no intervening upstream branch point and iExon 3' splice site between the exon and the REMS sequence. In the presence of a compound described herein, the exon 5' splice site does not undergo splicing with the downstream 3' splice site. Instead, functioning as a 5' splice site in the presence of a compound described herein, the iREMS sequence undergoes splicing with the downstream 3' splice site. In other embodiments, in the presence of a compound described herein, an upstream exon 5' splice site, an upstream branch point, and a functional iExon 3' splice site upstream from the intronic REMS, will undergo splicing. In certain embodiments, one or more sequence elements necessary to form an iExon splice junction may be present endogenously or non-endogenously. For example, one or more of the following sequence elements may be present naturally in an intron or an intron may be engineered to comprise one or more of the following sequences in 5' to 3' order: a first 5' splice site, a first branch point, a first 3' splice site, an iREMS, a second branch point, and a second 3' splice site. In certain embodiments, one or more snRNPs and trans factor elements necessary for splicing may be present beyond endogenous levels as a result of the presence of a compound described herein at various splice inducing sequence combinations. Without being bound by any theory or mechanism, the small molecule compounds described herein, in conjunction with the iREMS sequence, initiate the assembly of a splicing-competent spliceosome around a weak or incompletely defined exon (i.e., a nascent iExon). Splicing modifier compounds most likely enable a functional U1 snRNP—REMS interaction and, at least, have been shown to increase the affinity of one or more snRNPs and trans factor elements necessary for splicing, including U1, U2, U4, U5 and U6, whereby the interaction between the U1 snRNP, as well as other components of the pre-mRNA splicing machinery, and the nucleotides NNGA (SEQ ID NO: 3863) of the REMS are enhanced. In fact, we have discovered that the interaction of the U1 snRNP, the iREMS and the small molecule splicing modifier compounds described herein serve to define nascent exons by increasing the binding affinity of the pre-mRNA splicing machinery to the iREMS sequence, stabilizing U1 binding with the iREMS sequence, activating a 3' splice site and a branch point upstream from the iREMS and recruiting U2 snRNP and other trans-acting splicing factors such as U2AF (U2AF65 and U2AF35) and SF3A (SF3A1, SF3A2 and SF3A3) to the upstream branch point and 3' splice site. The branch point and 3' splice site may or may not be fully occupied in the absence of the compound but have been shown to become occupied after the compound has enabled the formation of a functional U1 snRNP—REMS complex. We have elaborated on the interaction of these key splicing machinery elements, showing that, in the presence of small molecule splicing modifier compounds such as, but certainly not limited to, those described herein, the mechanism of intronic spliceosome assembly can be mediated by iREMS interaction with such compounds, such that the intronic REMS sequence functions as a U1 snRNP binding site, resulting in intronic nucleotides spliced in the mature RNA transcript as an intronic exon.

In FIG. 1A, the intronic REMS is located in Intron 1 downstream from an Exon 1 5' splice site (i.e., a 5' splice site at the 3' end of Exon 1), a first branch point (BP) sequence and a first 3' splice site sequence and upstream from a second branch point sequence and a second 3' splice site sequence of Exon 2 in an RNA transcript (i.e., the precursor mRNA).

In the presence of a small molecule splicing modifier compound described herein the intronic REMS functions as a 5' splice site, whereby the nucleotides between the Exon 1 5' splice site and the first 3' splice site are removed to form a splice junction between Exon 1 and a nascent intronic exon and the nucleotides between the intronic REMS and the second 3' splice site sequence are removed to form a splice junction between iExon 1a and Exon 2, and allowing Exon 2 and the portion of the intron comprising nucloeotides from the first 3' splice site up to and including NNGA (SEQ ID NO: 3863) of the intronic REMS to be joined, thus introducing an intron-derived iExon 1a, generating a non-wild-type mRNA. In certain embodiments of FIG. 1A, one or more elements necessary to form a splice junction may be present endogenously or introduced, wherein the one or more elements are selected from the group consisting of the first branch point, the first 3' splice site, the intronic REMS, the second branch point and the second 3' splice site. While illustrated for Intron 1 here, this concept is generally applicable to any other intron in a pre-mRNA transcript.

In FIG. 1B, the intronic REMS is located in an intron of an RNA transcript downstream from an Exon 1 5' splice site (i.e., a 5' splice site at the 3' end of Exon 1) and upstream from an Intron 1 branch point sequence and a 3' splice site sequence of Exon 2 (i.e., a 3' splice site at the 5' end of Exon 2). In the presence of a small molecule splicing modifier compound described herein, the nucleotides between the Exon 1 5' splice site and the intronic REMS are retained and those between the intronic REMS and the Intron 1 3' splice site sequence (except the NNGA (SEQ ID NO: 3863) nucleotides of the intronic REMS) are removed, allowing Exon 1 and the portion of the intron comprising nucloeotides from those adjacent to the Exon 1 5' splice site up to and including NNGA (SEQ ID NO: 3863) of the intronic REMS and the Exon 2 nucleotides to be joined. The scope of the invention described herein is merely illustrated in this configuration for Exon 1 but is generally applicable to any other nascent iExon in an intronic sequence. The elements necessary to induce splicing of an iExon may be present in any configuration capable of recognition by the splicing machinery as an "exon." Accordingly, in the presence of a splicing modifier compound, the spliceosome recognizes the elements as exonic boundaries for removal of intervening intronic nucleotides between those boundaries. The configuration in this instance results in an iExon spliced between at least one upstream exon and one downstream exon of the same pre-mRNA transcript.

In FIG. 1C, the intronic REMS is located in Intron 2 downstream from an Exon 2 5' splice site (i.e., a 5' splice site at the 3' end of Exon 2) and upstream from an Intron 2 branch point sequence and a 3' splice site sequence of Exon 3 (i.e., a 3' splice site at the 5' end of Exon 3) in an RNA transcript. In the presence of a small molecule splicing modifier compound described herein, the nucleotides between the intronic REMS and the Exon 3 3' splice site sequence are removed, allowing Exon 3 and the portion of the intron comprising nucloeotides from those adjacent to the Exon 2 5' splice site up to and including NNGA (SEQ ID NO: 3863) of the intronic REMS to be joined. In this example, the endogenous splicing reaction between Exon 1 and Exon 2 is unaffected by the presence of a compound described herein, resulting in the complete removal of Intron 1. While illustrated for Exon 2 here, this concept is generally applicable to any other internal nascent intronic exon, i.e., an exon that is located between at least one upstream exon and one downstream exon of the same pre-mRNA transcript.

As used herein, an "exon 5' splice site", a "5' splice site of an exon" or the like refers to a 5' splice site at the 3' end of the exon, while an "exon 3' splice site", a "3' splice site of an exon" or the like refers to a 3' splice site at the 5' end of the exon.

In the presence of a small molecule splicing modifier compound described herein, the iREMS nucleotides retained in the formation of an iExon are selected from the group consisting of ANGA (SEQ ID NO: 5), CNGA (SEQ ID NO: 11), GNGA (SEQ ID NO: 17), UNGA (SEQ ID NO: 23), NAGA (SEQ ID NO: 6), NCGA (SEQ ID NO: 12), NGGA (SEQ ID NO: 18), NUGA (SEQ ID NO: 24), AAGA (SEQ ID NO: 7), ACGA (SEQ ID NO: 13), AGGA (SEQ ID NO: 19), AUGA (SEQ ID NO: 25), CAGA (SEQ ID NO: 8), CCGA (SEQ ID NO: 14), CGGA (SEQ ID NO: 20), CUGA (SEQ ID NO: 26), GAGA (SEQ ID NO: 9), GCGA (SEQ ID NO: 15), GGGA (SEQ ID NO: 21), GUGA (SEQ ID NO: 27), UAGA (SEQ ID NO: 10), UCGA (SEQ ID NO: 16), UGGA (SEQ ID NO: 22) and UUGA (SEQ ID NO: 28). The formation of an iExon may result in an RNA transcript having a non-functional open reading frame due to the inclusion of a frameshift, premature stop codon or internal deletions within the open reading frame. In other embodiments, the inclusion of an iExon may result in the mature mRNA having a functional open reading frame, producing a novel protein which may or may not be functional. RNA transcripts having a non-functional open reading frame due to the inclusion of a frameshift, premature stop codon or internal deletions within the open reading frame can be substrates for nonsense-mediated decay and thus have low abundance. Any intronic REMS-mediated alternative splicing modified RNA transcripts may also have altered stability, altered intracellular transport, altered 3' end formation efficiency and altered translation efficiency.

Accordingly, in one aspect, provided herein are methods for modulating the amount of RNA transcripts produced from precursor RNA containing an endogenous or non-endogenous intronic REMS. In another aspect, provided herein are artificial gene constructs comprising an endogenous or non-endogenous intronic REMS, which may be used in the context of, e.g., gene therapy or reporter assays. In another aspect, provided herein are methods for altering endogenous genes so that they contain an intronic REMS or an additional intronic REMS.

In another aspect, provided herein are methods for modulating the amount of one or more RNA transcripts (e.g., mRNA transcripts) or proteins thereof expressed as the product of one or more genes, wherein precursor RNA transcripts transcribed by the one or more genes comprise an intronic REMS, the methods comprising contacting a cell with a compound of Formula (I)

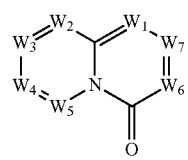
(I)

or a form thereof, wherein $w_1$, $w_2$, $w_3$, $w_4$, $w_5$, $w_6$ and $w_7$ are as defined herein. In one embodiment, provided herein is a method for modulating the amount of an RNA transcript produced from precursor RNA containing an intronic recognition element for splicing modifier (REMS), the method comprising contacting a cell containing the precursor RNA with a compound of Formula (I) or a form thereof, wherein the intronic REMS comprises the sequence NNGAgurngn (SEQ ID NO: 1), wherein r is adenine or guanine and n or N is any nucleotide, wherein the precursor RNA is a gene in Table 1. In certain embodiments, the precursor RNA is a gene in Table 7. In another embodiment, provided herein is a method for modulating the amount of an RNA transcript produced from precursor RNA containing an intronic recognition element for splicing modifier (REMS), the method comprising contacting the precursor RNA with a compound of Formula (I) or a form thereof, wherein the intronic REMS comprises the sequence NNGAgurngn (SEQ ID NO: 1), wherein r is adenine or guanine and n or N is any nucleotide, wherein the precursor RNA is a gene in Table 1. In some embodiments, the intronic REMS comprises the sequence NNGAguragu (SEQ ID NO: 3862) at the RNA level, wherein r is adenine or guanine and N is any nucleotide. In certain embodiments, the intronic REMS comprises a sequence selected from the group consisting of ANGAgurngn (SEQ ID NO: 29), CNGAgurngn (SEQ ID NO: 35), GNGAgurngn (SEQ ID NO: 41), UNGAgurngn (SEQ ID NO: 47), NAGAgurngn (SEQ ID NO: 30), NCGAgurngn (SEQ ID NO: 36), NGGAgurngn (SEQ ID NO: 42), NUGAgurngn (SEQ ID NO: 48), AAGAgurngn (SEQ ID NO: 31), ACGAgurngn (SEQ ID NO: 37), AGGAgurngn (SEQ ID NO: 43), AUGAgurngn (SEQ ID NO: 49), CAGAgurngn (SEQ ID NO: 32), CCGAgurngn (SEQ ID NO: 38), CGGAgurngn (SEQ ID NO: 44), CUGAgurngn (SEQ ID NO: 50), GAGAgurngn (SEQ ID NO: 33), GCGAgurngn (SEQ ID NO: 39), GGGAgurngn (SEQ ID NO: 45), GUGAgurngn (SEQ ID NO: 51), UAGAgurngn (SEQ ID NO: 34), UCGAgurngn (SEQ ID NO: 40), UGGAgurngn (SEQ ID NO: 46) and UUGAgurngn (SEQ ID NO: 52), wherein r is adenine or guanine and n or N is any nucleotide. In some embodiments, the intronic REMS comprises a sequence selected from the group consisting of ANGAguragu (SEQ ID NO: 437), CNGAguragu (SEQ ID NO: 443), GNGAguragu (SEQ ID NO: 449), UNGAguragu (SEQ ID NO: 455), NAGAguragu (SEQ ID NO: 438), NCGAguragu (SEQ ID NO: 444), NGGAguragu (SEQ ID NO: 450), NUGAguragu (SEQ ID NO: 456), AAGAguragu (SEQ ID NO: 439), ACGAguragu (SEQ ID NO: 445), AGGAguragu (SEQ ID NO: 451), AUGAguragu (SEQ ID NO: 457), CAGAguragu (SEQ ID NO: 440), CCGAguragu (SEQ ID NO: 446), CGGAguragu (SEQ ID NO: 452), CUGAguragu (SEQ ID NO: 458), GAGAguragu (SEQ ID NO: 441), GCGAguragu (SEQ ID NO: 447), GGGAguragu (SEQ ID NO: 453), GUGAguragu (SEQ ID NO: 459), UAGAguragu (SEQ ID NO: 442), UCGAguragu (SEQ ID NO: 448), UGGAguragu (SEQ ID NO: 454) and UUGAguragu (SEQ ID NO: 460) at the RNA level, wherein r is adenine or guanine, and N is any nucleotide. In one or more embodiments provided herein, N is adenine or guanine.

In a specific embodiment, the intronic REMS referred to in a method or artificial gene construct described herein comprises, at the RNA level, a sequence presented in the following table (wherein r is adenine or guanine, and n or N is any nucleotide):

TABLE 13

Intronic REMS RNA sequence (wherein r is adenine or guanine, and n or N is any nucleotide)

| SEQ ID NO. | Sequence |
|---|---|
| 29 | ANGAgurngn |
| 30 | NAGAgurngn |
| 31 | AAGAgurngn |
| 32 | CAGAgurngn |
| 33 | GAGAgurngn |
| 34 | UAGAgurngn |
| 35 | CNGAgurngn |
| 36 | NCGAgurngn |
| 37 | ACGAgurngn |
| 38 | CCGAgurngn |
| 39 | GCGAgurngn |
| 40 | UCGAgurngn |
| 41 | GNGAgurngn |
| 42 | NGGAgurngn |
| 43 | AGGAgurngn |
| 44 | CGGAgurngn |
| 45 | GGGAgurngn |
| 46 | UGGAgurngn |
| 47 | UNGAgurngn |
| 48 | NUGAgurngn |
| 49 | AUGAgurngn |
| 50 | CUGAgurngn |
| 51 | GUGAgurngn |
| 52 | UUGAgurngn |
| 53 | ANGAguragn |
| 54 | NAGAguragn |
| 55 | AAGAguragn |
| 56 | CAGAguragn |
| 57 | GAGAguragn |
| 58 | UAGAguragn |
| 59 | CNGAguragn |
| 60 | NCGAguragn |
| 61 | ACGAguragn |
| 62 | CCGAguragn |
| 63 | GCGAguragn |
| 64 | UCGAguragn |
| 65 | GNGAguragn |

TABLE 13-continued

Intronic REMS RNA sequence (wherein r is adenine or guanine, and n or N is any nucleotide)

| SEQ ID NO. | Sequence |
|---|---|
| 66 | NGGAguragn |
| 67 | AGGAguragn |
| 68 | CGGAguragn |
| 69 | GGGAguragn |
| 70 | UGGAguragn |
| 71 | UNGAguragn |
| 72 | NUGAguragn |
| 73 | AUGAguragn |
| 74 | CUGAguragn |
| 75 | GUGAguragn |
| 76 | UUGAguragn |
| 77 | ANGAgurcgn |
| 78 | NAGAgurcgn |
| 79 | AAGAgurcgn |
| 80 | CAGAgurcgn |
| 81 | GAGAgurcgn |
| 82 | UAGAgurcgn |
| 83 | CNGAgurcgn |
| 84 | NCGAgurcgn |
| 85 | ACGAgurcgn |
| 86 | CCGAgurcgn |
| 87 | GCGAgurcgn |
| 88 | UCGAgurcgn |
| 89 | GNGAgurcgn |
| 90 | NGGAgurcgn |
| 91 | AGGAgurcgn |
| 92 | CGGAgurcgn |
| 93 | GGGAgurcgn |
| 94 | UGGAgurcgn |
| 95 | UNGAgurcgn |
| 96 | NUGAgurcgn |
| 97 | AUGAgurcgn |
| 98 | CUGAgurcgn |
| 99 | GUGAgurcgn |
| 100 | UUGAgurcgn |
| 101 | ANGAgurggn |
| 102 | NAGAgurggn |

TABLE 13-continued

Intronic REMS RNA sequence (wherein r is adenine or guanine, and n or N is any nucleotide)

| SEQ ID NO. | Sequence |
|---|---|
| 103 | AAGAgurggn |
| 104 | CAGAgurggn |
| 105 | GAGAgurggn |
| 106 | UAGAgurggn |
| 107 | CNGAgurggn |
| 108 | NCGAgurggn |
| 109 | ACGAgurggn |
| 110 | CCGAgurggn |
| 111 | GCGAgurggn |
| 112 | UCGAgurggn |
| 113 | GNGAgurggn |
| 114 | NGGAgurggn |
| 115 | AGGAgurggn |
| 116 | CGGAgurggn |
| 117 | GGGAgurggn |
| 118 | UGGAgurggn |
| 119 | UNGAgurggn |
| 120 | NUGAgurggn |
| 121 | AUGAgurggn |
| 122 | CUGAgurggn |
| 123 | GUGAgurggn |
| 124 | UUGAgurggn |
| 125 | ANGAgurugn |
| 126 | NAGAgurugn |
| 127 | AAGAgurugn |
| 128 | CAGAgurugn |
| 129 | GAGAgurugn |
| 130 | UAGAgurugn |
| 131 | CNGAgurugn |
| 132 | NCGAgurugn |
| 133 | ACGAgurugn |
| 134 | CCGAgurugn |
| 135 | GCGAgurugn |
| 136 | UCGAgurugn |
| 137 | GNGAgurugn |
| 138 | NGGAgurugn |
| 139 | AGGAgurugn |
| 140 | CGGAgurugn |
| 141 | GGGAgurugn |
| 142 | UGGAgurugn |
| 143 | UNGAgurugn |
| 144 | NUGAgurugn |
| 145 | AUGAgurugn |
| 146 | CUGAgurugn |
| 147 | GUGAgurugn |
| 148 | UUGAgurugn |
| 149 | ANGAguraga |
| 150 | NAGAguraga |
| 151 | AAGAguraga |
| 152 | CAGAguraga |
| 153 | GAGAguraga |
| 154 | UAGAguraga |
| 155 | CNGAguraga |
| 156 | NCGAguraga |
| 157 | ACGAguraga |
| 158 | CCGAguraga |
| 159 | GCGAguraga |
| 160 | UCGAguraga |
| 161 | GNGAguraga |
| 162 | NGGAguraga |
| 163 | AGGAguraga |
| 164 | CGGAguraga |
| 165 | GGGAguraga |
| 166 | UGGAguraga |
| 167 | UNGAguraga |
| 168 | NUGAguraga |
| 169 | AUGAguraga |
| 170 | CUGAguraga |
| 171 | GUGAguraga |
| 172 | UUGAguraga |
| 173 | ANGAgurcga |
| 174 | NAGAgurcga |
| 175 | AAGAgurcga |
| 176 | CAGAgurcga |

TABLE 13-continued

Intronic REMS RNA sequence (wherein r is adenine or guanine, and n or N is any nucleotide)

| SEQ ID NO. | Sequence |
|---|---|
| 177 | GAGAgurcga |
| 178 | UAGAgurcga |
| 179 | CNGAgurcga |
| 180 | NCGAgurcga |
| 181 | ACGAgurcga |
| 182 | CCGAgurcga |
| 183 | GCGAgurcga |
| 184 | UCGAgurcga |
| 185 | GNGAgurcga |
| 186 | NGGAgurcga |
| 187 | AGGAgurcga |
| 188 | CGGAgurcga |
| 189 | GGGAgurcga |
| 190 | UGGAgurcga |
| 191 | UNGAgurcga |
| 192 | NUGAgurcga |
| 193 | AUGAgurcga |
| 194 | CUGAgurcga |
| 195 | GUGAgurcga |
| 196 | UUGAgurcga |
| 197 | ANGAgurgga |
| 198 | NAGAgurgga |
| 199 | AAGAgurgga |
| 200 | CAGAgurgga |
| 201 | GAGAgurgga |
| 202 | UAGAgurgga |
| 203 | CNGAgurgga |
| 204 | NCGAgurgga |
| 205 | ACGAgurgga |
| 206 | CCGAgurgga |
| 207 | GCGAgurgga |
| 208 | UCGAgurgga |
| 209 | GNGAgurgga |
| 210 | NGGAgurgga |
| 211 | AGGAgurgga |
| 212 | CGGAgurgga |
| 213 | GGGAgurgga |
| 214 | UGGAgurgga |
| 215 | UNGAgurgga |
| 216 | NUGAgurgga |
| 217 | AUGAgurgga |
| 218 | CUGAgurgga |
| 219 | GUGAgurgga |
| 220 | UUGAgurgga |
| 221 | ANGAguruga |
| 222 | NAGAguruga |
| 223 | AAGAguruga |
| 224 | CAGAguruga |
| 225 | GAGAguruga |
| 226 | UAGAguruga |
| 227 | CNGAguruga |
| 228 | NCGAguruga |
| 229 | ACGAguruga |
| 230 | CCGAguruga |
| 231 | GCGAguruga |
| 232 | UCGAguruga |
| 233 | GNGAguruga |
| 234 | NGGAguruga |
| 235 | AGGAguruga |
| 236 | CGGAguruga |
| 237 | GGGAguruga |
| 238 | UGGAguruga |
| 239 | UNGAguruga |
| 240 | NUGAguruga |
| 241 | AUGAguruga |
| 242 | CUGAguruga |
| 243 | GUGAguruga |
| 244 | UUGAguruga |
| 245 | ANGAguragc |
| 246 | NAGAguragc |
| 247 | AAGAguragc |
| 248 | CAGAguragc |
| 249 | GAGAguragc |
| 250 | UAGAguragc |

TABLE 13-continued

Intronic REMS RNA sequence (wherein r is adenine or guanine, and n or N is any nucleotide)

| SEQ ID NO. | Sequence |
|---|---|
| 251 | CNGAguragc |
| 252 | NCGAguragc |
| 253 | ACGAguragc |
| 254 | CCGAguragc |
| 255 | GCGAguragc |
| 256 | UCGAguragc |
| 257 | GNGAguragc |
| 258 | NGGAguragc |
| 259 | AGGAguragc |
| 260 | CGGAguragc |
| 261 | GGGAguragc |
| 262 | UGGAguragc |
| 263 | UNGAguragc |
| 264 | NUGAguragc |
| 265 | AUGAguragc |
| 266 | CUGAguragc |
| 267 | GUGAguragc |
| 268 | UUGAguragc |
| 269 | ANGAgurcgc |
| 270 | NAGAgurcgc |
| 271 | AAGAgurcgc |
| 272 | CAGAgurcgc |
| 273 | GAGAgurcgc |
| 274 | UAGAgurcgc |
| 275 | CNGAgurcgc |
| 276 | NCGAgurcgc |
| 277 | ACGAgurcgc |
| 278 | CCGAgurcgc |
| 279 | GCGAgurcgc |
| 280 | UCGAgurcgc |
| 281 | GNGAgurcgc |
| 282 | NGGAgurcgc |
| 283 | AGGAgurcgc |
| 284 | CGGAgurcgc |
| 285 | GGGAgurcgc |
| 286 | UGGAgurcgc |
| 287 | UNGAgurcgc |
| 288 | NUGAgurcgc |
| 289 | AUGAgurcgc |
| 290 | CUGAgurcgc |
| 291 | GUGAgurcgc |
| 292 | UUGAgurcgc |
| 293 | ANGAgurggc |
| 294 | NAGAgurggc |
| 295 | AAGAgurggc |
| 296 | CAGAgurggc |
| 297 | GAGAgurggc |
| 298 | UAGAgurggc |
| 299 | CNGAgurggc |
| 300 | NCGAgurggc |
| 301 | ACGAgurggc |
| 302 | CCGAgurggc |
| 303 | GCGAgurggc |
| 304 | UCGAgurggc |
| 305 | GNGAgurggc |
| 306 | NGGAgurggc |
| 307 | AGGAgurggc |
| 308 | CGGAgurggc |
| 309 | GGGAgurggc |
| 310 | UGGAgurggc |
| 311 | UNGAgurggc |
| 312 | NUGAgurggc |
| 313 | AUGAgurggc |
| 314 | CUGAgurggc |
| 315 | GUGAgurggc |
| 316 | UUGAgurggc |
| 317 | ANGAgurugc |
| 318 | NAGAgurugc |
| 319 | AAGAgurugc |
| 320 | CAGAgurugc |
| 321 | GAGAgurugc |
| 322 | UAGAgurugc |
| 323 | CNGAgurugc |
| 324 | NCGAgurugc |

TABLE 13-continued

Intronic REMS RNA sequence (wherein r is adenine or guanine, and n or N is any nucleotide)

| SEQ ID NO. | Sequence |
|---|---|
| 325 | ACGAgurugc |
| 326 | CCGAgurugc |
| 327 | GCGAgurugc |
| 328 | UCGAgurugc |
| 329 | GNGAgurugc |
| 330 | NGGAgurugc |
| 331 | AGGAgurugc |
| 332 | CGGAgurugc |
| 333 | GGGAgurugc |
| 334 | UGGAgurugc |
| 335 | UNGAgurugc |
| 336 | NUGAgurugc |
| 337 | AUGAgurugc |
| 338 | CUGAgurugc |
| 339 | GUGAgurugc |
| 340 | UUGAgurugc |
| 341 | ANGAguragg |
| 342 | NAGAguragg |
| 343 | AAGAguragg |
| 344 | CAGAguragg |
| 345 | GAGAguragg |
| 346 | UAGAguragg |
| 347 | CNGAguragg |
| 348 | NCGAguragg |
| 349 | ACGAguragg |
| 350 | CCGAguragg |
| 351 | GCGAguragg |
| 352 | UCGAguragg |
| 353 | GNGAguragg |
| 354 | NGGAguragg |
| 355 | AGGAguragg |
| 356 | CGGAguragg |
| 357 | GGGAguragg |
| 358 | UGGAguragg |
| 359 | UNGAguragg |
| 360 | NUGAguragg |
| 361 | AUGAguragg |
| 362 | CUGAguragg |
| 363 | GUGAguragg |
| 364 | UUGAguragg |
| 365 | ANGAgurcgg |
| 366 | NAGAgurcgg |
| 367 | AAGAgurcgg |
| 368 | CAGAgurcgg |
| 369 | GAGAgurcgg |
| 370 | UAGAgurcgg |
| 371 | CNGAgurcgg |
| 372 | NCGAgurcgg |
| 373 | ACGAgurcgg |
| 374 | CCGAgurcgg |
| 375 | GCGAgurcgg |
| 376 | UCGAgurcgg |
| 377 | GNGAgurcgg |
| 378 | NGGAgurcgg |
| 379 | AGGAgurcgg |
| 380 | CGGAgurcgg |
| 381 | GGGAgurcgg |
| 382 | UGGAgurcgg |
| 383 | UNGAgurcgg |
| 384 | NUGAgurcgg |
| 385 | AUGAgurcgg |
| 386 | CUGAgurcgg |
| 387 | GUGAgurcgg |
| 388 | UUGAgurcgg |
| 389 | ANGAgurggg |
| 390 | NAGAgurggg |
| 391 | AAGAgurggg |
| 392 | CAGAgurggg |
| 393 | GAGAgurggg |
| 394 | UAGAgurggg |
| 395 | CNGAgurggg |
| 396 | NCGAgurggg |
| 397 | ACGAgurggg |
| 398 | CCGAgurggg |

TABLE 13-continued

Intronic REMS RNA sequence (wherein r is adenine or guanine, and n or N is any nucleotide)

| SEQ ID NO. | Sequence |
|---|---|
| 399 | GCGAgurggg |
| 400 | UCGAgurggg |
| 401 | GNGAgurggg |
| 402 | NGGAgurggg |
| 403 | AGGAgurggg |
| 404 | CGGAgurggg |
| 405 | GGGAgurggg |
| 406 | UGGAgurggg |
| 407 | UNGAgurggg |
| 408 | NUGAgurggg |
| 409 | AUGAgurggg |
| 410 | CUGAgurggg |
| 411 | GUGAgurggg |
| 412 | UUGAgurggg |
| 413 | ANGAgurugg |
| 414 | NAGAgurugg |
| 415 | AAGAgurugg |
| 416 | CAGAgurugg |
| 417 | GAGAgurugg |
| 418 | UAGAgurugg |
| 419 | CNGAgurugg |
| 420 | NCGAgurugg |
| 421 | ACGAgurugg |
| 422 | CCGAgurugg |
| 423 | GCGAgurugg |
| 424 | UCGAgurugg |
| 425 | GNGAgurugg |
| 426 | NGGAgurugg |
| 427 | AGGAgurugg |
| 428 | CGGAgurugg |
| 429 | GGGAgurugg |
| 430 | UGGAgurugg |
| 431 | UNGAgurugg |
| 432 | NUGAgurugg |
| 433 | AUGAgurugg |
| 434 | CUGAgurugg |
| 435 | GUGAgurugg |
| 436 | UUGAgurugg |
| 437 | ANGAguragu |
| 438 | NAGAguragu |
| 439 | AAGAguragu |
| 440 | CAGAguragu |
| 441 | GAGAguragu |
| 442 | UAGAguragu |
| 443 | CNGAguragu |
| 444 | NCGAguragu |
| 445 | ACGAguragu |
| 446 | CCGAguragu |
| 447 | GCGAguragu |
| 448 | UCGAguragu |
| 449 | GNGAguragu |
| 450 | NGGAguragu |
| 451 | AGGAguragu |
| 452 | CGGAguragu |
| 453 | GGGAguragu |
| 454 | UGGAguragu |
| 455 | UNGAguragu |
| 456 | NUGAguragu |
| 457 | AUGAguragu |
| 458 | CUGAguragu |
| 459 | GUGAguragu |
| 460 | UUGAguragu |
| 461 | ANGAgurcgu |
| 462 | NAGAgurcgu |
| 463 | AAGAgurcgu |
| 464 | CAGAgurcgu |
| 465 | GAGAgurcgu |
| 466 | UAGAgurcgu |
| 467 | CNGAgurcgu |
| 468 | NCGAgurcgu |
| 469 | ACGAgurcgu |
| 470 | CCGAgurcgu |
| 471 | GCGAgurcgu |
| 472 | UCGAgurcgu |

TABLE 13-continued

Intronic REMS RNA sequence (wherein r is adenine or guanine, and n or N is any nucleotide)

| SEQ ID NO. | Sequence |
|---|---|
| 473 | GNGAgurcgu |
| 474 | NGGAgurcgu |
| 475 | AGGAgurcgu |
| 476 | CGGAgurcgu |
| 477 | GGGAgurcgu |
| 478 | UGGAgurcgu |
| 479 | UNGAgurcgu |
| 480 | NUGAgurcgu |
| 481 | AUGAgurcgu |
| 482 | CUGAgurcgu |
| 483 | GUGAgurcgu |
| 484 | UUGAgurcgu |
| 485 | ANGAgurggu |
| 486 | NAGAgurggu |
| 487 | AAGAgurggu |
| 488 | CAGAgurggu |
| 489 | GAGAgurggu |
| 490 | UAGAgurggu |
| 491 | CNGAgurggu |
| 492 | NCGAgurggu |
| 493 | ACGAgurggu |
| 494 | CCGAgurggu |
| 495 | GCGAgurggu |
| 496 | UCGAgurggu |
| 497 | GNGAgurggu |
| 498 | NGGAgurggu |
| 499 | AGGAgurggu |
| 500 | CGGAgurggu |
| 501 | GGGAgurggu |
| 502 | UGGAgurggu |
| 503 | UNGAgurggu |
| 504 | NUGAgurggu |
| 505 | AUGAgurggu |
| 506 | CUGAgurggu |
| 507 | GUGAgurggu |
| 508 | UUGAgurggu |
| 509 | ANGAgurugu |
| 510 | NAGAgurugu |
| 511 | AAGAgurugu |
| 512 | CAGAgurugu |
| 513 | GAGAgurugu |
| 514 | UAGAgurugu |
| 515 | CNGAgurugu |
| 516 | NCGAgurugu |
| 517 | ACGAgurugu |
| 518 | CCGAgurugu |
| 519 | GCGAgurugu |
| 520 | UCGAgurugu |
| 521 | GNGAgurugu |
| 522 | NGGAgurugu |
| 523 | AGGAgurugu |
| 524 | CGGAgurugu |
| 525 | GGGAgurugu |
| 526 | UGGAgurugu |
| 527 | UNGAgurugu |
| 528 | NUGAgurugu |
| 529 | AUGAgurugu |
| 530 | CUGAgurugu |
| 531 | GUGAgurugu |
| 532 | UUGAgurugu |
| 533 | ANGAgurnga |
| 534 | NAGAgurnga |
| 535 | AAGAgurnga |
| 536 | CAGAgurnga |
| 537 | GAGAgurnga |
| 538 | UAGAgurnga |
| 539 | CNGAgurnga |
| 540 | NCGAgurnga |
| 541 | ACGAgurnga |
| 542 | CCGAgurnga |
| 543 | GCGAgurnga |
| 544 | UCGAgurnga |
| 545 | GNGAgurnga |
| 546 | NGGAgurnga |

TABLE 13-continued

Intronic REMS RNA sequence (wherein r is adenine or guanine, and n or N is any nucleotide)

| SEQ ID NO. | Sequence |
|---|---|
| 547 | AGGAgurnga |
| 548 | CGGAgurnga |
| 549 | GGGAgurnga |
| 550 | UGGAgurnga |
| 551 | UNGAgurnga |
| 552 | NUGAgurnga |
| 553 | AUGAgurnga |
| 554 | CUGAgurnga |
| 555 | GUGAgurnga |
| 556 | UUGAgurnga |
| 557 | ANGAgurngc |
| 558 | NAGAgurngc |
| 559 | AAGAgurngc |
| 560 | CAGAgurngc |
| 561 | GAGAgurngc |
| 562 | UAGAgurngc |
| 563 | CNGAgurngc |
| 564 | NCGAgurngc |
| 565 | ACGAgurngc |
| 566 | CCGAgurngc |
| 567 | GCGAgurngc |
| 568 | UCGAgurngc |
| 569 | GNGAgurngc |
| 570 | NGGAgurngc |
| 571 | AGGAgurngc |
| 572 | CGGAgurngc |
| 573 | GGGAgurngc |
| 574 | UGGAgurngc |
| 575 | UNGAgurngc |
| 576 | NUGAgurngc |
| 577 | AUGAgurngc |
| 578 | CUGAgurngc |
| 579 | GUGAgurngc |
| 580 | UUGAgurngc |
| 581 | ANGAgurngg |
| 582 | NAGAgurngg |
| 583 | AAGAgurngg |
| 584 | CAGAgurngg |
| 585 | GAGAgurngg |
| 586 | UAGAgurngg |
| 587 | CNGAgurngg |
| 588 | NCGAgurngg |
| 589 | ACGAgurngg |
| 590 | CCGAgurngg |
| 591 | GCGAgurngg |
| 592 | UCGAgurngg |
| 593 | GNGAgurngg |
| 594 | NGGAgurngg |
| 595 | AGGAgurngg |
| 596 | CGGAgurngg |
| 597 | GGGAgurngg |
| 598 | UGGAgurngg |
| 599 | UNGAgurngg |
| 600 | NUGAgurngg |
| 601 | AUGAgurngg |
| 602 | CUGAgurngg |
| 603 | GUGAgurngg |
| 604 | UUGAgurngg |
| 605 | ANGAgurngu |
| 606 | NAGAgurngu |
| 607 | AAGAgurngu |
| 608 | CAGAgurngu |
| 609 | GAGAgurngu |
| 610 | UAGAgurngu |
| 611 | CNGAgurngu |
| 612 | NCGAgurngu |
| 613 | ACGAgurngu |
| 614 | CCGAgurngu |
| 615 | GCGAgurngu |
| 616 | UCGAgurngu |
| 617 | GNGAgurngu |
| 618 | NGGAgurngu |
| 619 | AGGAgurngu |
| 620 | CGGAgurngu |

TABLE 13-continued

Intronic REMS RNA sequence (wherein r is adenine or guanine, and n or N is any nucleotide)

| SEQ ID NO. | Sequence |
|---|---|
| 621 | GGGAgurngu |
| 622 | UGGAgurngu |
| 623 | UNGAgurngu |
| 624 | NUGAgurngu |
| 625 | AUGAgurngu |
| 626 | CUGAgurngu |
| 627 | GUGAgurngu |
| 628 | UUGAgurngu |
| 629 | ANGAguangn |
| 630 | NAGAguangn |
| 631 | AAGAguangn |
| 632 | CAGAguangn |
| 633 | GAGAguangn |
| 634 | UAGAguangn |
| 635 | CNGAguangn |
| 636 | NCGAguangn |
| 637 | ACGAguangn |
| 638 | CCGAguangn |
| 639 | GCGAguangn |
| 640 | UCGAguangn |
| 641 | GNGAguangn |
| 642 | NGGAguangn |
| 643 | AGGAguangn |
| 644 | CGGAguangn |
| 645 | GGGAguangn |
| 646 | UGGAguangn |
| 647 | UNGAguangn |
| 648 | NUGAguangn |
| 649 | AUGAguangn |
| 650 | CUGAguangn |
| 651 | GUGAguangn |
| 652 | UUGAguangn |
| 653 | ANGAguaagn |
| 654 | NAGAguaagn |
| 655 | AAGAguaagn |
| 656 | CAGAguaagn |
| 657 | GAGAguaagn |
| 658 | UAGAguaagn |
| 659 | CNGAguaagn |
| 660 | NCGAguaagn |
| 661 | ACGAguaagn |
| 662 | CCGAguaagn |
| 663 | GCGAguaagn |
| 664 | UCGAguaagn |
| 665 | GNGAguaagn |
| 666 | NGGAguaagn |
| 667 | AGGAguaagn |
| 668 | CGGAguaagn |
| 669 | GGGAguaagn |
| 670 | UGGAguaagn |
| 671 | UNGAguaagn |
| 672 | NUGAguaagn |
| 673 | AUGAguaagn |
| 674 | CUGAguaagn |
| 675 | GUGAguaagn |
| 676 | UUGAguaagn |
| 677 | ANGAguacgn |
| 678 | NAGAguacgn |
| 679 | AAGAguacgn |
| 680 | CAGAguacgn |
| 681 | GAGAguacgn |
| 682 | UAGAguacgn |
| 683 | CNGAguacgn |
| 684 | NCGAguacgn |
| 685 | ACGAguacgn |
| 686 | CCGAguacgn |
| 687 | GCGAguacgn |
| 688 | UCGAguacgn |
| 689 | GNGAguacgn |
| 690 | NGGAguacgn |
| 691 | AGGAguacgn |
| 692 | CGGAguacgn |
| 693 | GGGAguacgn |
| 694 | UGGAguacgn |

TABLE 13-continued

Intronic REMS RNA sequence (wherein r is adenine or guanine, and n or N is any nucleotide)

| SEQ ID NO. | Sequence |
|---|---|
| 695 | UNGAguacgn |
| 696 | NUGAguacgn |
| 697 | AUGAguacgn |
| 698 | CUGAguacgn |
| 699 | GUGAguacgn |
| 700 | UUGAguacgn |
| 701 | ANGAguaggn |
| 702 | NAGAguaggn |
| 703 | AAGAguaggn |
| 704 | CAGAguaggn |
| 705 | GAGAguaggn |
| 706 | UAGAguaggn |
| 707 | CNGAguaggn |
| 708 | NCGAguaggn |
| 709 | ACGAguaggn |
| 710 | CCGAguaggn |
| 711 | GCGAguaggn |
| 712 | UCGAguaggn |
| 713 | GNGAguaggn |
| 714 | NGGAguaggn |
| 715 | AGGAguaggn |
| 716 | CGGAguaggn |
| 717 | GGGAguaggn |
| 718 | UGGAguaggn |
| 719 | UNGAguaggn |
| 720 | NUGAguaggn |
| 721 | AUGAguaggn |
| 722 | CUGAguaggn |
| 723 | GUGAguaggn |
| 724 | UUGAguaggn |
| 725 | ANGAguaugn |
| 726 | NAGAguaugn |
| 727 | AAGAguaugn |
| 728 | CAGAguaugn |
| 729 | GAGAguaugn |
| 730 | UAGAguaugn |
| 731 | CNGAguaugn |

TABLE 13-continued

Intronic REMS RNA sequence (wherein r is adenine or guanine, and n or N is any nucleotide)

| SEQ ID NO. | Sequence |
|---|---|
| 732 | NCGAguaugn |
| 733 | ACGAguaugn |
| 734 | CCGAguaugn |
| 735 | GCGAguaugn |
| 736 | UCGAguaugn |
| 737 | GNGAguaugn |
| 738 | NGGAguaugn |
| 739 | AGGAguaugn |
| 740 | CGGAguaugn |
| 741 | GGGAguaugn |
| 742 | UGGAguaugn |
| 743 | UNGAguaugn |
| 744 | NUGAguaugn |
| 745 | AUGAguaugn |
| 746 | CUGAguaugn |
| 747 | GUGAguaugn |
| 748 | UUGAguaugn |
| 749 | ANGAguaaga |
| 750 | NAGAguaaga |
| 751 | AAGAguaaga |
| 752 | CAGAguaaga |
| 753 | GAGAguaaga |
| 754 | UAGAguaaga |
| 755 | CNGAguaaga |
| 756 | NCGAguaaga |
| 757 | ACGAguaaga |
| 758 | CCGAguaaga |
| 759 | GCGAguaaga |
| 760 | UCGAguaaga |
| 761 | GNGAguaaga |
| 762 | NGGAguaaga |
| 763 | AGGAguaaga |
| 764 | CGGAguaaga |
| 765 | GGGAguaaga |
| 766 | UGGAguaaga |
| 767 | UNGAguaaga |
| 768 | NUGAguaaga |

TABLE 13-continued

Intronic REMS RNA sequence (wherein r is adenine or guanine, and n or N is any nucleotide)

| SEQ ID NO. | Sequence |
|---|---|
| 769 | AUGAguaaga |
| 770 | CUGAguaaga |
| 771 | GUGAguaaga |
| 772 | UUGAguaaga |
| 773 | ANGAguacga |
| 774 | NAGAguacga |
| 775 | AAGAguacga |
| 776 | CAGAguacga |
| 777 | GAGAguacga |
| 778 | UAGAguacga |
| 779 | CNGAguacga |
| 780 | NCGAguacga |
| 781 | ACGAguacga |
| 782 | CCGAguacga |
| 783 | GCGAguacga |
| 784 | UCGAguacga |
| 785 | GNGAguacga |
| 786 | NGGAguacga |
| 787 | AGGAguacga |
| 788 | CGGAguacga |
| 789 | GGGAguacga |
| 790 | UGGAguacga |
| 791 | UNGAguacga |
| 792 | NUGAguacga |
| 793 | AUGAguacga |
| 794 | CUGAguacga |
| 795 | GUGAguacga |
| 796 | UUGAguacga |
| 797 | ANGAguagga |
| 798 | NAGAguagga |
| 799 | AAGAguagga |
| 800 | CAGAguagga |
| 801 | GAGAguagga |
| 802 | UAGAguagga |
| 803 | CNGAguagga |
| 804 | NCGAguagga |
| 805 | ACGAguagga |
| 806 | CCGAguagga |
| 807 | GCGAguagga |
| 808 | UCGAguagga |
| 809 | GNGAguagga |
| 810 | NGGAguagga |
| 811 | AGGAguagga |
| 812 | CGGAguagga |
| 813 | GGGAguagga |
| 814 | UGGAguagga |
| 815 | UNGAguagga |
| 816 | NUGAguagga |
| 817 | AUGAguagga |
| 818 | CUGAguagga |
| 819 | GUGAguagga |
| 820 | UUGAguagga |
| 821 | ANGAguauga |
| 822 | NAGAguauga |
| 823 | AAGAguauga |
| 824 | CAGAguauga |
| 825 | GAGAguauga |
| 826 | UAGAguauga |
| 827 | CNGAguauga |
| 828 | NCGAguauga |
| 829 | ACGAguauga |
| 830 | CCGAguauga |
| 831 | GCGAguauga |
| 832 | UCGAguauga |
| 833 | GNGAguauga |
| 834 | NGGAguauga |
| 835 | AGGAguauga |
| 836 | CGGAguauga |
| 837 | GGGAguauga |
| 838 | UGGAguauga |
| 839 | UNGAguauga |
| 840 | NUGAguauga |
| 841 | AUGAguauga |
| 842 | CUGAguauga |

TABLE 13-continued

Intronic REMS RNA sequence (wherein r is adenine or guanine, and n or N is any nucleotide)

| SEQ ID NO. | Sequence |
|---|---|
| 843 | GUGAguauga |
| 844 | UUGAguauga |
| 845 | ANGAguaagc |
| 846 | NAGAguaagc |
| 847 | AAGAguaagc |
| 848 | CAGAguaagc |
| 849 | GAGAguaagc |
| 850 | UAGAguaagc |
| 851 | CNGAguaagc |
| 852 | NCGAguaagc |
| 853 | ACGAguaagc |
| 854 | CCGAguaagc |
| 855 | GCGAguaagc |
| 856 | UCGAguaagc |
| 857 | GNGAguaagc |
| 858 | NGGAguaagc |
| 859 | AGGAguaagc |
| 860 | CGGAguaagc |
| 861 | GGGAguaagc |
| 862 | UGGAguaagc |
| 863 | UNGAguaagc |
| 864 | NUGAguaagc |
| 865 | AUGAguaagc |
| 866 | CUGAguaagc |
| 867 | GUGAguaagc |
| 868 | UUGAguaagc |
| 869 | ANGAguacgc |
| 870 | NAGAguacgc |
| 871 | AAGAguacgc |
| 872 | CAGAguacgc |
| 873 | GAGAguacgc |
| 874 | UAGAguacgc |
| 875 | CNGAguacgc |
| 876 | NCGAguacgc |
| 877 | ACGAguacgc |
| 878 | CCGAguacgc |
| 879 | GCGAguacgc |
| 880 | UCGAguacgc |
| 881 | GNGAguacgc |
| 882 | NGGAguacgc |
| 883 | AGGAguacgc |
| 884 | CGGAguacgc |
| 885 | GGGAguacgc |
| 886 | UGGAguacgc |
| 887 | UNGAguacgc |
| 888 | NUGAguacgc |
| 889 | AUGAguacgc |
| 890 | CUGAguacgc |
| 891 | GUGAguacgc |
| 892 | UUGAguacgc |
| 893 | ANGAguaggc |
| 894 | NAGAguaggc |
| 895 | AAGAguaggc |
| 896 | CAGAguaggc |
| 897 | GAGAguaggc |
| 898 | UAGAguaggc |
| 899 | CNGAguaggc |
| 900 | NCGAguaggc |
| 901 | ACGAguaggc |
| 902 | CCGAguaggc |
| 903 | GCGAguaggc |
| 904 | UCGAguaggc |
| 905 | GNGAguaggc |
| 906 | NGGAguaggc |
| 907 | AGGAguaggc |
| 908 | CGGAguaggc |
| 909 | GGGAguaggc |
| 910 | UGGAguaggc |
| 911 | UNGAguaggc |
| 912 | NUGAguaggc |
| 913 | AUGAguaggc |
| 914 | CUGAguaggc |
| 915 | GUGAguaggc |
| 916 | UUGAguaggc |

TABLE 13-continued

Intronic REMS RNA sequence (wherein r is adenine or guanine, and n or N is any nucleotide)

| SEQ ID NO. | Sequence |
|---|---|
| 917 | ANGAguaugc |
| 918 | NAGAguaugc |
| 919 | AAGAguaugc |
| 920 | CAGAguaugc |
| 921 | GAGAguaugc |
| 922 | UAGAguaugc |
| 923 | CNGAguaugc |
| 924 | NCGAguaugc |
| 925 | ACGAguaugc |
| 926 | CCGAguaugc |
| 927 | GCGAguaugc |
| 928 | UCGAguaugc |
| 929 | GNGAguaugc |
| 930 | NGGAguaugc |
| 931 | AGGAguaugc |
| 932 | CGGAguaugc |
| 933 | GGGAguaugc |
| 934 | UGGAguaugc |
| 935 | UNGAguaugc |
| 936 | NUGAguaugc |
| 937 | AUGAguaugc |
| 938 | CUGAguaugc |
| 939 | GUGAguaugc |
| 940 | UUGAguaugc |
| 941 | ANGAguaagg |
| 942 | NAGAguaagg |
| 943 | AAGAguaagg |
| 944 | CAGAguaagg |
| 945 | GAGAguaagg |
| 946 | UAGAguaagg |
| 947 | CNGAguaagg |
| 948 | NCGAguaagg |
| 949 | ACGAguaagg |
| 950 | CCGAguaagg |
| 951 | GCGAguaagg |
| 952 | UCGAguaagg |
| 953 | GNGAguaagg |

TABLE 13-continued

Intronic REMS RNA sequence (wherein r is adenine or guanine, and n or N is any nucleotide)

| SEQ ID NO. | Sequence |
|---|---|
| 954 | NGGAguaagg |
| 955 | AGGAguaagg |
| 956 | CGGAguaagg |
| 957 | GGGAguaagg |
| 958 | UGGAguaagg |
| 959 | UNGAguaagg |
| 960 | NUGAguaagg |
| 961 | AUGAguaagg |
| 962 | CUGAguaagg |
| 963 | GUGAguaagg |
| 964 | UUGAguaagg |
| 965 | ANGAguacgg |
| 966 | NAGAguacgg |
| 967 | AAGAguacgg |
| 968 | CAGAguacgg |
| 969 | GAGAguacgg |
| 970 | UAGAguacgg |
| 971 | CNGAguacgg |
| 972 | NCGAguacgg |
| 973 | ACGAguacgg |
| 974 | CCGAguacgg |
| 975 | GCGAguacgg |
| 976 | UCGAguacgg |
| 977 | GNGAguacgg |
| 978 | NGGAguacgg |
| 979 | AGGAguacgg |
| 980 | CGGAguacgg |
| 981 | GGGAguacgg |
| 982 | UGGAguacgg |
| 983 | UNGAguacgg |
| 984 | NUGAguacgg |
| 985 | AUGAguacgg |
| 986 | CUGAguacgg |
| 987 | GUGAguacgg |
| 988 | UUGAguacgg |
| 989 | ANGAguaggg |
| 990 | NAGAguaggg |

TABLE 13-continued

Intronic REMS RNA sequence (wherein r is adenine or guanine, and n or N is any nucleotide)

| SEQ ID NO. | Sequence |
|---|---|
| 991 | AAGAguaggg |
| 992 | CAGAguaggg |
| 993 | GAGAguaggg |
| 994 | UAGAguaggg |
| 995 | CNGAguaggg |
| 996 | NCGAguaggg |
| 997 | ACGAguaggg |
| 998 | CCGAguaggg |
| 999 | GCGAguaggg |
| 1000 | UCGAguaggg |
| 1001 | GNGAguaggg |
| 1002 | NGGAguaggg |
| 1003 | AGGAguaggg |
| 1004 | CGGAguaggg |
| 1005 | GGGAguaggg |
| 1006 | UGGAguaggg |
| 1007 | UNGAguaggg |
| 1008 | NUGAguaggg |
| 1009 | AUGAguaggg |
| 1010 | CUGAguaggg |
| 1011 | GUGAguaggg |
| 1012 | UUGAguaggg |
| 1013 | ANGAguaugg |
| 1014 | NAGAguaugg |
| 1015 | AAGAguaugg |
| 1016 | CAGAguaugg |
| 1017 | GAGAguaugg |
| 1018 | UAGAguaugg |
| 1019 | CNGAguaugg |
| 1020 | NCGAguaugg |
| 1021 | ACGAguaugg |
| 1022 | CCGAguaugg |
| 1023 | GCGAguaugg |
| 1024 | UCGAguaugg |
| 1025 | GNGAguaugg |
| 1026 | NGGAguaugg |
| 1027 | AGGAguaugg |
| 1028 | CGGAguaugg |
| 1029 | GGGAguaugg |
| 1030 | UGGAguaugg |
| 1031 | UNGAguaugg |
| 1032 | NUGAguaugg |
| 1033 | AUGAguaugg |
| 1034 | CUGAguaugg |
| 1035 | GUGAguaugg |
| 1036 | UUGAguaugg |
| 1037 | ANGAguaagu |
| 1038 | NAGAguaagu |
| 1039 | AAGAguaagu |
| 1040 | CAGAguaagu |
| 1041 | GAGAguaagu |
| 1042 | UAGAguaagu |
| 1043 | CNGAguaagu |
| 1044 | NCGAguaagu |
| 1045 | ACGAguaagu |
| 1046 | CCGAguaagu |
| 1047 | GCGAguaagu |
| 1048 | UCGAguaagu |
| 1049 | GNGAguaagu |
| 1050 | NGGAguaagu |
| 1051 | AGGAguaagu |
| 1052 | CGGAguaagu |
| 1053 | GGGAguaagu |
| 1054 | UGGAguaagu |
| 1055 | UNGAguaagu |
| 1056 | NUGAguaagu |
| 1057 | AUGAguaagu |
| 1058 | CUGAguaagu |
| 1059 | GUGAguaagu |
| 1060 | UUGAguaagu |
| 1061 | ANGAguacgu |
| 1062 | NAGAguacgu |
| 1063 | AAGAguacgu |
| 1064 | CAGAguacgu |

TABLE 13-continued

Intronic REMS RNA sequence (wherein r is adenine or guanine, and n or N is any nucleotide)

| SEQ ID NO. | Sequence |
|---|---|
| 1065 | GAGAguacgu |
| 1066 | UAGAguacgu |
| 1067 | CNGAguacgu |
| 1068 | NCGAguacgu |
| 1069 | ACGAguacgu |
| 1070 | CCGAguacgu |
| 1071 | GCGAguacgu |
| 1072 | UCGAguacgu |
| 1073 | GNGAguacgu |
| 1074 | NGGAguacgu |
| 1075 | AGGAguacgu |
| 1076 | CGGAguacgu |
| 1077 | GGGAguacgu |
| 1078 | UGGAguacgu |
| 1079 | UNGAguacgu |
| 1080 | NUGAguacgu |
| 1081 | AUGAguacgu |
| 1082 | CUGAguacgu |
| 1083 | GUGAguacgu |
| 1084 | UUGAguacgu |
| 1085 | ANGAguaggu |
| 1086 | NAGAguaggu |
| 1087 | AAGAguaggu |
| 1088 | CAGAguaggu |
| 1089 | GAGAguaggu |
| 1090 | UAGAguaggu |
| 1091 | CNGAguaggu |
| 1092 | NCGAguaggu |
| 1093 | ACGAguaggu |
| 1094 | CCGAguaggu |
| 1095 | GCGAguaggu |
| 1096 | UCGAguaggu |
| 1097 | GNGAguaggu |
| 1098 | NGGAguaggu |
| 1099 | AGGAguaggu |
| 1100 | CGGAguaggu |
| 1101 | GGGAguaggu |
| 1102 | UGGAguaggu |
| 1103 | UNGAguaggu |
| 1104 | NUGAguaggu |
| 1105 | AUGAguaggu |
| 1106 | CUGAguaggu |
| 1107 | GUGAguaggu |
| 1108 | UUGAguaggu |
| 1109 | ANGAguaugu |
| 1110 | NAGAguaugu |
| 1111 | AAGAguaugu |
| 1112 | CAGAguaugu |
| 1113 | GAGAguaugu |
| 1114 | UAGAguaugu |
| 1115 | CNGAguaugu |
| 1116 | NCGAguaugu |
| 1117 | ACGAguaugu |
| 1118 | CCGAguaugu |
| 1119 | GCGAguaugu |
| 1120 | UCGAguaugu |
| 1121 | GNGAguaugu |
| 1122 | NGGAguaugu |
| 1123 | AGGAguaugu |
| 1124 | CGGAguaugu |
| 1125 | GGGAguaugu |
| 1126 | UGGAguaugu |
| 1127 | UNGAguaugu |
| 1128 | NUGAguaugu |
| 1129 | AUGAguaugu |
| 1130 | CUGAguaugu |
| 1131 | GUGAguaugu |
| 1132 | UUGAguaugu |
| 1133 | ANGAguanga |
| 1134 | NAGAguanga |
| 1135 | AAGAguanga |
| 1136 | CAGAguanga |
| 1137 | GAGAguanga |
| 1138 | UAGAguanga |

TABLE 13-continued

Intronic REMS RNA sequence (wherein r is adenine or guanine, and n or N is any nucleotide)

| SEQ ID NO. | Sequence |
|---|---|
| 1139 | CNGAguanga |
| 1140 | NCGAguanga |
| 1141 | ACGAguanga |
| 1142 | CCGAguanga |
| 1143 | GCGAguanga |
| 1144 | UCGAguanga |
| 1145 | GNGAguanga |
| 1146 | NGGAguanga |
| 1147 | AGGAguanga |
| 1148 | CGGAguanga |
| 1149 | GGGAguanga |
| 1150 | UGGAguanga |
| 1151 | UNGAguanga |
| 1152 | NUGAguanga |
| 1153 | AUGAguanga |
| 1154 | CUGAguanga |
| 1155 | GUGAguanga |
| 1156 | UUGAguanga |
| 1157 | ANGAguangc |
| 1158 | NAGAguangc |
| 1159 | AAGAguangc |
| 1160 | CAGAguangc |
| 1161 | GAGAguangc |
| 1162 | UAGAguangc |
| 1163 | CNGAguangc |
| 1164 | NCGAguangc |
| 1165 | ACGAguangc |
| 1166 | CCGAguangc |
| 1167 | GCGAguangc |
| 1168 | UCGAguangc |
| 1169 | GNGAguangc |
| 1170 | NGGAguangc |
| 1171 | AGGAguangc |
| 1172 | CGGAguangc |
| 1173 | GGGAguangc |
| 1174 | UGGAguangc |
| 1175 | UNGAguangc |
| 1176 | NUGAguangc |
| 1177 | AUGAguangc |
| 1178 | CUGAguangc |
| 1179 | GUGAguangc |
| 1180 | UUGAguangc |
| 1181 | ANGAguangg |
| 1182 | NAGAguangg |
| 1183 | AAGAguangg |
| 1184 | CAGAguangg |
| 1185 | GAGAguangg |
| 1186 | UAGAguangg |
| 1187 | CNGAguangg |
| 1188 | NCGAguangg |
| 1189 | ACGAguangg |
| 1190 | CCGAguangg |
| 1191 | GCGAguangg |
| 1192 | UCGAguangg |
| 1193 | GNGAguangg |
| 1194 | NGGAguangg |
| 1195 | AGGAguangg |
| 1196 | CGGAguangg |
| 1197 | GGGAguangg |
| 1198 | UGGAguangg |
| 1199 | UNGAguangg |
| 1200 | NUGAguangg |
| 1201 | AUGAguangg |
| 1202 | CUGAguangg |
| 1203 | GUGAguangg |
| 1204 | UUGAguangg |
| 1205 | ANGAguangu |
| 1206 | NAGAguangu |
| 1207 | AAGAguangu |
| 1208 | CAGAguangu |
| 1209 | GAGAguangu |
| 1210 | UAGAguangu |
| 1211 | CNGAguangu |
| 1212 | NCGAguangu |

TABLE 13-continued

Intronic REMS RNA sequence (wherein r is adenine or guanine, and n or N is any nucleotide)

| SEQ ID NO. | Sequence |
|---|---|
| 1213 | ACGAguangu |
| 1214 | CCGAguangu |
| 1215 | GCGAguangu |
| 1216 | UCGAguangu |
| 1217 | GNGAguangu |
| 1218 | NGGAguangu |
| 1219 | AGGAguangu |
| 1220 | CGGAguangu |
| 1221 | GGGAguangu |
| 1222 | UGGAguangu |
| 1223 | UNGAguangu |
| 1224 | NUGAguangu |
| 1225 | AUGAguangu |
| 1226 | CUGAguangu |
| 1227 | GUGAguangu |
| 1228 | UUGAguangu |
| 1229 | ANGAgugngn |
| 1230 | NAGAgugngn |
| 1231 | AAGAgugngn |
| 1232 | CAGAgugngn |
| 1233 | GAGAgugngn |
| 1234 | UAGAgugngn |
| 1235 | CNGAgugngn |
| 1236 | NCGAgugngn |
| 1237 | ACGAgugngn |
| 1238 | CCGAgugngn |
| 1239 | GCGAgugngn |
| 1240 | UCGAgugngn |
| 1241 | GNGAgugngn |
| 1242 | NGGAgugngn |
| 1243 | AGGAgugngn |
| 1244 | CGGAgugngn |
| 1245 | GGGAgugngn |
| 1246 | UGGAgugngn |
| 1247 | UNGAgugngn |
| 1248 | NUGAgugngn |
| 1249 | AUGAgugngn |
| 1250 | CUGAgugngn |
| 1251 | GUGAgugngn |
| 1252 | UUGAgugngn |
| 1253 | ANGAgugagn |
| 1254 | NAGAgugagn |
| 1255 | AAGAgugagn |
| 1256 | CAGAgugagn |
| 1257 | GAGAgugagn |
| 1258 | UAGAgugagn |
| 1259 | CNGAgugagn |
| 1260 | NCGAgugagn |
| 1261 | ACGAgugagn |
| 1262 | CCGAgugagn |
| 1263 | GCGAgugagn |
| 1264 | UCGAgugagn |
| 1265 | GNGAgugagn |
| 1266 | NGGAgugagn |
| 1267 | AGGAgugagn |
| 1268 | CGGAgugagn |
| 1269 | GGGAgugagn |
| 1270 | UGGAgugagn |
| 1271 | UNGAgugagn |
| 1272 | NUGAgugagn |
| 1273 | AUGAgugagn |
| 1274 | CUGAgugagn |
| 1275 | GUGAgugagn |
| 1276 | UUGAgugagn |
| 1277 | ANGAgugcgn |
| 1278 | NAGAgugcgn |
| 1279 | AAGAgugcgn |
| 1280 | CAGAgugcgn |
| 1281 | GAGAgugcgn |
| 1282 | UAGAgugcgn |
| 1283 | CNGAgugcgn |
| 1284 | NCGAgugcgn |
| 1285 | ACGAgugcgn |
| 1286 | CCGAgugcgn |

TABLE 13-continued

Intronic REMS RNA sequence (wherein r is adenine or guanine, and n or N is any nucleotide)

| SEQ ID NO. | Sequence |
| --- | --- |
| 1287 | GCGAgugcgn |
| 1288 | UCGAgugcgn |
| 1289 | GNGAgugcgn |
| 1290 | NGGAgugcgn |
| 1291 | AGGAgugcgn |
| 1292 | CGGAgugcgn |
| 1293 | GGGAgugcgn |
| 1294 | UGGAgugcgn |
| 1295 | UNGAgugcgn |
| 1296 | NUGAgugcgn |
| 1297 | AUGAgugcgn |
| 1298 | CUGAgugcgn |
| 1299 | GUGAgugcgn |
| 1300 | UUGAgugcgn |
| 1301 | ANGAgugggn |
| 1302 | NAGAgugggn |
| 1303 | AAGAgugggn |
| 1304 | CAGAgugggn |
| 1305 | GAGAgugggn |
| 1306 | UAGAgugggn |
| 1307 | CNGAgugggn |
| 1308 | NCGAgugggn |
| 1309 | ACGAgugggn |
| 1310 | CCGAgugggn |
| 1311 | GCGAgugggn |
| 1312 | UCGAgugggn |
| 1313 | GNGAgugggn |
| 1314 | NGGAgugggn |
| 1315 | AGGAgugggn |
| 1316 | CGGAgugggn |
| 1317 | GGGAgugggn |
| 1318 | UGGAgugggn |
| 1319 | UNGAgugggn |
| 1320 | NUGAgugggn |
| 1321 | AUGAgugggn |
| 1322 | CUGAgugggn |
| 1323 | GUGAgugggn |
| 1324 | UUGAgugggn |
| 1325 | ANGAgugugn |
| 1326 | NAGAgugugn |
| 1327 | AAGAgugugn |
| 1328 | CAGAgugugn |
| 1329 | GAGAgugugn |
| 1330 | UAGAgugugn |
| 1331 | CNGAgugugn |
| 1332 | NCGAgugugn |
| 1333 | ACGAgugugn |
| 1334 | CCGAgugugn |
| 1335 | GCGAgugugn |
| 1336 | UCGAgugugn |
| 1337 | GNGAgugugn |
| 1338 | NGGAgugugn |
| 1339 | AGGAgugugn |
| 1340 | CGGAgugugn |
| 1341 | GGGAgugugn |
| 1342 | UGGAgugugn |
| 1343 | UNGAgugugn |
| 1344 | NUGAgugugn |
| 1345 | AUGAgugugn |
| 1346 | CUGAgugugn |
| 1347 | GUGAgugugn |
| 1348 | UUGAgugugn |
| 1349 | ANGAgugaga |
| 1350 | NAGAgugaga |
| 1351 | AAGAgugaga |
| 1352 | CAGAgugaga |
| 1353 | GAGAgugaga |
| 1354 | UAGAgugaga |
| 1355 | CNGAgugaga |
| 1356 | NCGAgugaga |
| 1357 | ACGAgugaga |
| 1358 | CCGAgugaga |
| 1359 | GCGAgugaga |
| 1360 | UCGAgugaga |

TABLE 13-continued

Intronic REMS RNA sequence (wherein r is adenine or guanine, and n or N is any nucleotide)

| SEQ ID NO. | Sequence |
|---|---|
| 1361 | GNGAgugaga |
| 1362 | NGGAgugaga |
| 1363 | AGGAgugaga |
| 1364 | CGGAgugaga |
| 1365 | GGGAgugaga |
| 1366 | UGGAgugaga |
| 1367 | UNGAgugaga |
| 1368 | NUGAgugaga |
| 1369 | AUGAgugaga |
| 1370 | CUGAgugaga |
| 1371 | GUGAgugaga |
| 1372 | UUGAgugaga |
| 1373 | ANGAgugcga |
| 1374 | NAGAgugcga |
| 1375 | AAGAgugcga |
| 1376 | CAGAgugcga |
| 1377 | GAGAgugcga |
| 1378 | UAGAgugcga |
| 1379 | CNGAgugcga |
| 1380 | NCGAgugcga |
| 1381 | ACGAgugcga |
| 1382 | CCGAgugcga |
| 1383 | GCGAgugcga |
| 1384 | UCGAgugcga |
| 1385 | GNGAgugcga |
| 1386 | NGGAgugcga |
| 1387 | AGGAgugcga |
| 1388 | CGGAgugcga |
| 1389 | GGGAgugcga |
| 1390 | UGGAgugcga |
| 1391 | UNGAgugcga |
| 1392 | NUGAgugcga |
| 1393 | AUGAgugcga |
| 1394 | CUGAgugcga |
| 1395 | GUGAgugcga |
| 1396 | UUGAgugcga |
| 1397 | ANGAguggga |
| 1398 | NAGAguggga |
| 1399 | AAGAguggga |
| 1400 | CAGAguggga |
| 1401 | GAGAguggga |
| 1402 | UAGAguggga |
| 1403 | CNGAguggga |
| 1404 | NCGAguggga |
| 1405 | ACGAguggga |
| 1406 | CCGAguggga |
| 1407 | GCGAguggga |
| 1408 | UCGAguggga |
| 1409 | GNGAguggga |
| 1410 | NGGAguggga |
| 1411 | AGGAguggga |
| 1412 | CGGAguggga |
| 1413 | GGGAguggga |
| 1414 | UGGAguggga |
| 1415 | UNGAguggga |
| 1416 | NUGAguggga |
| 1417 | AUGAguggga |
| 1418 | CUGAguggga |
| 1419 | GUGAguggga |
| 1420 | UUGAguggga |
| 1421 | ANGAguguga |
| 1422 | NAGAguguga |
| 1423 | AAGAguguga |
| 1424 | CAGAguguga |
| 1425 | GAGAguguga |
| 1426 | UAGAguguga |
| 1427 | CNGAguguga |
| 1428 | NCGAguguga |
| 1429 | ACGAguguga |
| 1430 | CCGAguguga |
| 1431 | GCGAguguga |
| 1432 | UCGAguguga |
| 1433 | GNGAguguga |
| 1434 | NGGAguguga |

TABLE 13-continued

Intronic REMS RNA sequence (wherein r is adenine or guanine, and n or N is any nucleotide)

| SEQ ID NO. | Sequence |
|---|---|
| 1435 | AGGAguguga |
| 1436 | CGGAguguga |
| 1437 | GGGAguguga |
| 1438 | UGGAguguga |
| 1439 | UNGAguguga |
| 1440 | NUGAguguga |
| 1441 | AUGAguguga |
| 1442 | CUGAguguga |
| 1443 | GUGAguguga |
| 1444 | UUGAguguga |
| 1445 | ANGAgugagc |
| 1446 | NAGAgugagc |
| 1447 | AAGAgugagc |
| 1448 | CAGAgugagc |
| 1449 | GAGAgugagc |
| 1450 | UAGAgugagc |
| 1451 | CNGAgugagc |
| 1452 | NCGAgugagc |
| 1453 | ACGAgugagc |
| 1454 | CCGAgugagc |
| 1455 | GCGAgugagc |
| 1456 | UCGAgugagc |
| 1457 | GNGAgugagc |
| 1458 | NGGAgugagc |
| 1459 | AGGAgugagc |
| 1460 | CGGAgugagc |
| 1461 | GGGAgugagc |
| 1462 | UGGAgugagc |
| 1463 | UNGAgugagc |
| 1464 | NUGAgugagc |
| 1465 | AUGAgugagc |
| 1466 | CUGAgugagc |
| 1467 | GUGAgugagc |
| 1468 | UUGAgugagc |
| 1469 | ANGAgugcgc |
| 1470 | NAGAgugcgc |
| 1471 | AAGAgugcgc |

TABLE 13-continued

Intronic REMS RNA sequence (wherein r is adenine or guanine, and n or N is any nucleotide)

| SEQ ID NO. | Sequence |
|---|---|
| 1472 | CAGAgugcgc |
| 1473 | GAGAgugcgc |
| 1474 | UAGAgugcgc |
| 1475 | CNGAgugcgc |
| 1476 | NCGAgugcgc |
| 1477 | ACGAgugcgc |
| 1478 | CCGAgugcgc |
| 1479 | GCGAgugcgc |
| 1480 | UCGAgugcgc |
| 1481 | GNGAgugcgc |
| 1482 | NGGAgugcgc |
| 1483 | AGGAgugcgc |
| 1484 | CGGAgugcgc |
| 1485 | GGGAgugcgc |
| 1486 | UGGAgugcgc |
| 1487 | UNGAgugcgc |
| 1488 | NUGAgugcgc |
| 1489 | AUGAgugcgc |
| 1490 | CUGAgugcgc |
| 1491 | GUGAgugcgc |
| 1492 | UUGAgugcgc |
| 1493 | ANGAgugggc |
| 1494 | NAGAgugggc |
| 1495 | AAGAgugggc |
| 1496 | CAGAgugggc |
| 1497 | GAGAgugggc |
| 1498 | UAGAgugggc |
| 1499 | CNGAgugggc |
| 1500 | NCGAgugggc |
| 1501 | ACGAgugggc |
| 1502 | CCGAgugggc |
| 1503 | GCGAgugggc |
| 1504 | UCGAgugggc |
| 1505 | GNGAgugggc |
| 1506 | NGGAgugggc |
| 1507 | AGGAgugggc |
| 1508 | CGGAgugggc |

TABLE 13-continued

Intronic REMS RNA sequence (wherein r is adenine or guanine, and n or N is any nucleotide)

| SEQ ID NO. | Sequence |
|---|---|
| 1509 | GGGAgugggc |
| 1510 | UGGAgugggc |
| 1511 | UNGAgugggc |
| 1512 | NUGAgugggc |
| 1513 | AUGAgugggc |
| 1514 | CUGAgugggc |
| 1515 | GUGAgugggc |
| 1516 | UUGAgugggc |
| 1517 | ANGAgugugc |
| 1518 | NAGAgugugc |
| 1519 | AAGAgugugc |
| 1520 | CAGAgugugc |
| 1521 | GAGAgugugc |
| 1522 | UAGAgugugc |
| 1523 | CNGAgugugc |
| 1524 | NCGAgugugc |
| 1525 | ACGAgugugc |
| 1526 | CCGAgugugc |
| 1527 | GCGAgugugc |
| 1528 | UCGAgugugc |
| 1529 | GNGAgugugc |
| 1530 | NGGAgugugc |
| 1531 | AGGAgugugc |
| 1532 | CGGAgugugc |
| 1533 | GGGAgugugc |
| 1534 | UGGAgugugc |
| 1535 | UNGAgugugc |
| 1536 | NUGAgugugc |
| 1537 | AUGAgugugc |
| 1538 | CUGAgugugc |
| 1539 | GUGAgugugc |
| 1540 | UUGAgugugc |
| 1541 | ANGAgugagg |
| 1542 | NAGAgugagg |
| 1543 | AAGAgugagg |
| 1544 | CAGAgugagg |
| 1545 | GAGAgugagg |

TABLE 13-continued

Intronic REMS RNA sequence (wherein r is adenine or guanine, and n or N is any nucleotide)

| SEQ ID NO. | Sequence |
|---|---|
| 1546 | UAGAgugagg |
| 1547 | CNGAgugagg |
| 1548 | NCGAgugagg |
| 1549 | ACGAgugagg |
| 1550 | CCGAgugagg |
| 1551 | GCGAgugagg |
| 1552 | UCGAgugagg |
| 1553 | GNGAgugagg |
| 1554 | NGGAgugagg |
| 1555 | AGGAgugagg |
| 1556 | CGGAgugagg |
| 1557 | GGGAgugagg |
| 1558 | UGGAgugagg |
| 1559 | UNGAgugagg |
| 1560 | NUGAgugagg |
| 1561 | AUGAgugagg |
| 1562 | CUGAgugagg |
| 1563 | GUGAgugagg |
| 1564 | UUGAgugagg |
| 1565 | ANGAgugcgg |
| 1566 | NAGAgugcgg |
| 1567 | AAGAgugcgg |
| 1568 | CAGAgugcgg |
| 1569 | GAGAgugcgg |
| 1570 | UAGAgugcgg |
| 1571 | CNGAgugcgg |
| 1572 | NCGAgugcgg |
| 1573 | ACGAgugcgg |
| 1574 | CCGAgugcgg |
| 1575 | GCGAgugcgg |
| 1576 | UCGAgugcgg |
| 1577 | GNGAgugcgg |
| 1578 | NGGAgugcgg |
| 1579 | AGGAgugcgg |
| 1580 | CGGAgugcgg |
| 1581 | GGGAgugcgg |
| 1582 | UGGAgugcgg |

TABLE 13-continued

Intronic REMS RNA sequence (wherein r is adenine or guanine, and n or N is any nucleotide)

| SEQ ID NO. | Sequence |
|---|---|
| 1583 | UNGAgugcgg |
| 1584 | NUGAgugcgg |
| 1585 | AUGAgugcgg |
| 1586 | CUGAgugcgg |
| 1587 | GUGAgugcgg |
| 1588 | UUGAgugcgg |
| 1589 | ANGAgugggg |
| 1590 | NAGAgugggg |
| 1591 | AAGAgugggg |
| 1592 | CAGAgugggg |
| 1593 | GAGAgugggg |
| 1594 | UAGAgugggg |
| 1595 | CNGAgugggg |
| 1596 | NCGAgugggg |
| 1597 | ACGAgugggg |
| 1598 | CCGAgugggg |
| 1599 | GCGAgugggg |
| 1600 | UCGAgugggg |
| 1601 | GNGAgugggg |
| 1602 | NGGAgugggg |
| 1603 | AGGAgugggg |
| 1604 | CGGAgugggg |
| 1605 | GGGAgugggg |
| 1606 | UGGAgugggg |
| 1607 | UNGAgugggg |
| 1608 | NUGAgugggg |
| 1609 | AUGAgugggg |
| 1610 | CUGAgugggg |
| 1611 | GUGAgugggg |
| 1612 | UUGAgugggg |
| 1613 | ANGAgugugg |
| 1614 | NAGAgugugg |
| 1615 | AAGAgugugg |
| 1616 | CAGAgugugg |
| 1617 | GAGAgugugg |
| 1618 | UAGAgugugg |
| 1619 | CNGAgugugg |

TABLE 13-continued

Intronic REMS RNA sequence (wherein r is adenine or guanine, and n or N is any nucleotide)

| SEQ ID NO. | Sequence |
|---|---|
| 1620 | NCGAgugugg |
| 1621 | ACGAgugugg |
| 1622 | CCGAgugugg |
| 1623 | GCGAgugugg |
| 1624 | UCGAgugugg |
| 1625 | GNGAgugugg |
| 1626 | NGGAgugugg |
| 1627 | AGGAgugugg |
| 1628 | CGGAgugugg |
| 1629 | GGGAgugugg |
| 1630 | UGGAgugugg |
| 1631 | UNGAgugugg |
| 1632 | NUGAgugugg |
| 1633 | AUGAgugugg |
| 1634 | CUGAgugugg |
| 1635 | GUGAgugugg |
| 1636 | UUGAgugugg |
| 1637 | ANGAgugagu |
| 1638 | NAGAgugagu |
| 1639 | AAGAgugagu |
| 1640 | CAGAgugagu |
| 1641 | GAGAgugagu |
| 1642 | UAGAgugagu |
| 1643 | CNGAgugagu |
| 1644 | NCGAgugagu |
| 1645 | ACGAgugagu |
| 1646 | CCGAgugagu |
| 1647 | GCGAgugagu |
| 1648 | UCGAgugagu |
| 1649 | GNGAgugagu |
| 1650 | NGGAgugagu |
| 1651 | AGGAgugagu |
| 1652 | CGGAgugagu |
| 1653 | GGGAgugagu |
| 1654 | UGGAgugagu |
| 1655 | UNGAgugagu |
| 1656 | NUGAgugagu |

TABLE 13-continued

Intronic REMS RNA sequence (wherein r is adenine or guanine, and n or N is any nucleotide)

| SEQ ID NO. | Sequence |
|---|---|
| 1657 | AUGAgugagu |
| 1658 | CUGAgugagu |
| 1659 | GUGAgugagu |
| 1660 | UUGAgugagu |
| 1661 | ANGAgugcgu |
| 1662 | NAGAgugcgu |
| 1663 | AAGAgugcgu |
| 1664 | CAGAgugcgu |
| 1665 | GAGAgugcgu |
| 1666 | UAGAgugcgu |
| 1667 | CNGAgugcgu |
| 1668 | NCGAgugcgu |
| 1669 | ACGAgugcgu |
| 1670 | CCGAgugcgu |
| 1671 | GCGAgugcgu |
| 1672 | UCGAgugcgu |
| 1673 | GNGAgugcgu |
| 1674 | NGGAgugcgu |
| 1675 | AGGAgugcgu |
| 1676 | CGGAgugcgu |
| 1677 | GGGAgugcgu |
| 1678 | UGGAgugcgu |
| 1679 | UNGAgugcgu |
| 1680 | NUGAgugcgu |
| 1681 | AUGAgugcgu |
| 1682 | CUGAgugcgu |
| 1683 | GUGAgugcgu |
| 1684 | UUGAgugcgu |
| 1685 | ANGAgugggu |
| 1686 | NAGAgugggu |
| 1687 | AAGAgugggu |
| 1688 | CAGAgugggu |
| 1689 | GAGAgugggu |
| 1690 | UAGAgugggu |
| 1691 | CNGAgugggu |
| 1692 | NCGAgugggu |
| 1693 | ACGAgugggu |
| 1694 | CCGAgugggu |
| 1695 | GCGAgugggu |
| 1696 | UCGAgugggu |
| 1697 | GNGAgugggu |
| 1698 | NGGAgugggu |
| 1699 | AGGAgugggu |
| 1700 | CGGAgugggu |
| 1701 | GGGAgugggu |
| 1702 | UGGAgugggu |
| 1703 | UNGAgugggu |
| 1704 | NUGAgugggu |
| 1705 | AUGAgugggu |
| 1706 | CUGAgugggu |
| 1707 | GUGAgugggu |
| 1708 | UUGAgugggu |
| 1709 | ANGAgugugu |
| 1710 | NAGAgugugu |
| 1711 | AAGAgugugu |
| 1712 | CAGAgugugu |
| 1713 | GAGAgugugu |
| 1714 | UAGAgugugu |
| 1715 | CNGAgugugu |
| 1716 | NCGAgugugu |
| 1717 | ACGAgugugu |
| 1718 | CCGAgugugu |
| 1719 | GCGAgugugu |
| 1720 | UCGAgugugu |
| 1721 | GNGAgugugu |
| 1722 | NGGAgugugu |
| 1723 | AGGAgugugu |
| 1724 | CGGAgugugu |
| 1725 | GGGAgugugu |
| 1726 | UGGAgugugu |
| 1727 | UNGAgugugu |
| 1728 | NUGAgugugu |
| 1729 | AUGAgugugu |
| 1730 | CUGAgugugu |

TABLE 13-continued

Intronic REMS RNA sequence (wherein r is adenine or guanine, and n or N is any nucleotide)

| SEQ ID NO. | Sequence |
|---|---|
| 1731 | GUGAgugugu |
| 1732 | UUGAgugugu |
| 1733 | ANGAgugnga |
| 1734 | NAGAgugnga |
| 1735 | AAGAgugnga |
| 1736 | CAGAgugnga |
| 1737 | GAGAgugnga |
| 1738 | UAGAgugnga |
| 1739 | CNGAgugnga |
| 1740 | NCGAgugnga |
| 1741 | ACGAgugnga |
| 1742 | CCGAgugnga |
| 1743 | GCGAgugnga |
| 1744 | UCGAgugnga |
| 1745 | GNGAgugnga |
| 1746 | NGGAgugnga |
| 1747 | AGGAgugnga |
| 1748 | CGGAgugnga |
| 1749 | GGGAgugnga |
| 1750 | UGGAgugnga |
| 1751 | UNGAgugnga |
| 1752 | NUGAgugnga |
| 1753 | AUGAgugnga |
| 1754 | CUGAgugnga |
| 1755 | GUGAgugnga |
| 1756 | UUGAgugnga |
| 1757 | ANGAgugngc |
| 1758 | NAGAgugngc |
| 1759 | AAGAgugngc |
| 1760 | CAGAgugngc |
| 1761 | GAGAgugngc |
| 1762 | UAGAgugngc |
| 1763 | CNGAgugngc |
| 1764 | NCGAgugngc |
| 1765 | ACGAgugngc |
| 1766 | CCGAgugngc |
| 1767 | GCGAgugngc |
| 1768 | UCGAgugngc |
| 1769 | GNGAgugngc |
| 1770 | NGGAgugngc |
| 1771 | AGGAgugngc |
| 1772 | CGGAgugngc |
| 1773 | GGGAgugngc |
| 1774 | UGGAgugngc |
| 1775 | UNGAgugngc |
| 1776 | NUGAgugngc |
| 1777 | AUGAgugngc |
| 1778 | CUGAgugngc |
| 1779 | GUGAgugngc |
| 1780 | UUGAgugngc |
| 1781 | ANGAgugngg |
| 1782 | NAGAgugngg |
| 1783 | AAGAgugngg |
| 1784 | CAGAgugngg |
| 1785 | GAGAgugngg |
| 1786 | UAGAgugngg |
| 1787 | CNGAgugngg |
| 1788 | NCGAgugngg |
| 1789 | ACGAgugngg |
| 1790 | CCGAgugngg |
| 1791 | GCGAgugngg |
| 1792 | UCGAgugngg |
| 1793 | GNGAgugngg |
| 1794 | NGGAgugngg |
| 1795 | AGGAgugngg |
| 1796 | CGGAgugngg |
| 1797 | GGGAgugngg |
| 1798 | UGGAgugngg |
| 1799 | UNGAgugngg |
| 1800 | NUGAgugngg |
| 1801 | AUGAgugngg |
| 1802 | CUGAgugngg |
| 1803 | GUGAgugngg |
| 1804 | UUGAgugngg |

TABLE 13-continued

Intronic REMS RNA sequence (wherein r is adenine or guanine, and n or N is any nucleotide)

| SEQ ID NO. | Sequence |
|---|---|
| 1805 | ANGAgugngu |
| 1806 | NAGAgugngu |
| 1807 | AAGAgugngu |
| 1808 | CAGAgugngu |
| 1809 | GAGAgugngu |
| 1810 | UAGAgugngu |
| 1811 | CNGAgugngu |
| 1812 | NCGAgugngu |
| 1813 | ACGAgugngu |
| 1814 | CCGAgugngu |
| 1815 | GCGAgugngu |
| 1816 | UCGAgugngu |
| 1817 | GNGAgugngu |
| 1818 | NGGAgugngu |
| 1819 | AGGAgugngu |
| 1820 | CGGAgugngu |
| 1821 | GGGAgugngu |
| 1822 | UGGAgugngu |
| 1823 | UNGAgugngu |
| 1824 | NUGAgugngu |
| 1825 | AUGAgugngu |
| 1826 | CUGAgugngu |
| 1827 | GUGAgugngu |
| 1828 | UUGAgugngu |

In one embodiment, provided herein are methods for modulating the amount of one, two, three or more RNA transcripts of a gene, by way of nonlimiting example, disclosed in Table 1, infra, the method comprising contacting a cell with a compound of Formula (I) or a form thereof. In another embodiment, provided herein are methods for modulating the amount of one, two, three or more RNA transcripts of a gene, disclosed in Table 16 or Tables 2-7, infra, wherein the precursor transcript transcribed from the gene comprises an intronic REMS, the method comprising contacting a cell with a compound of Formula (I) or a form thereof. In another embodiment, provided herein are methods for modulating the amount of one, two, three or more RNA transcripts of a gene, disclosed in International Patent Application No. PCT/US2014/071252 (International Publication No. WO 2015/105657), wherein the precursor transcript transcribed from the gene comprises an intronic REMS, the method comprising contacting a cell with a compound of Formula (I) or a form thereof. In another embodiment, provided herein are methods for modulating the amount of one, two, three or more RNA transcripts of a gene, disclosed in International Patent Application No. PCT/US2016/034864 (International Publication No. WO 2016/196386), wherein the precursor transcript transcribed from the gene comprises an intronic REMS, the method comprising contacting a cell with a compound of Formula (I) or a form thereof.

In another embodiment, provided herein are methods for modulating the amount of one, two, three or more RNA transcripts of a gene, disclosed in Table 1, infra, wherein the precursor transcript transcribed from the gene comprises an intronic REMS, the method comprising contacting a cell with a compound of Formula (I) or a form thereof. In another embodiment, provided herein are methods for modulating the amount of one, two, three or more RNA transcripts of a gene disclosed in Table 7, infra, comprising contacting a cell with a compound of Formula (I) or a form thereof. See the example section for additional information regarding the genes in Table 7. In certain embodiments, the cell is contacted with the compound of Formula (I) or a form thereof in a cell culture. In other embodiments, the cell is contacted with the compound of Formula (I) or a form thereof in a subject (e.g., a non-human animal subject or a human subject). In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described infra. In some embodiments, a compound of Formula (I) is a compound selected from a compound described herein.

In another aspect, provided herein are methods for modulating the amount of one, two, three or more RNA transcripts of a gene, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In one embodiment, provided herein are methods for modulating the amount of one, two, three or more RNA transcripts of a gene, by way of nonlimiting example, disclosed in Table 1, infra, the methods comprising administering to a human or non-human subject thereof a compound of Formula (I) or a form thereof, or a pharmaceutical composition comprising a compound of Formula (I) or a form thereof and a pharmaceutically acceptable carrier, excipient or diluent.

In another embodiment, provided herein are methods for modulating the amount of one, two, three or more RNA transcripts of a gene, disclosed in Tables 2-7, infra, wherein the precursor RNA transcript transcribed from the gene comprises an intronic REMS, the methods comprising administering to a human or non-human subject thereof a compound of Formula (I) or a form thereof, or a pharmaceutical composition comprising a compound of Formula (I) or a form thereof and a pharmaceutically acceptable carrier, excipient or diluent.

In another embodiment, provided herein are methods for modulating the amount of one, two, three or more RNA transcripts of a gene, disclosed in International Patent Application No. PCT/US2014/071252 (International Publication No. WO 2015/105657), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for modulating the amount of one, two, three or more RNA transcripts of a gene, disclosed in International Patent Application No. PCT/US2016/034864 (International Publication No. WO 2016/196386), wherein the precursor transcript transcribed from the gene comprises an intronic REMS, the method comprising contacting a cell with a compound of Formula (I) or a form thereof, or a pharmaceutical composition comprising a compound of Formula (I) or a form thereof and a pharmaceutically acceptable carrier, excipient or diluent. In another embodiment, provided herein are methods for modulating the amount of one, two, three or more RNA transcripts of a gene, disclosed in Table 1, infra, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another embodiment, provided herein are methods for modulating the amount of one, two, three or more RNA transcripts of a gene disclosed in Table 7, infra, comprising administering to a human or non-human subject a compound of Formula (I) or a form thereof, or a pharmaceutical composition comprising a compound of Formula (I) or a form thereof and a pharmaceutically acceptable carrier, excipient or diluent. See the example section for additional information regarding the genes in Table 7. In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described infra. In some embodiments, a compound of Formula (I) is a compound selected from a compound described herein.

In another embodiment, provided herein is a method for modulating the amount of an RNA transcript comprising a RNA nucleotide sequence, wherein the RNA nucleotide sequence comprises two exons and an intron, wherein one exon is upstream of the intron and the other exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn (SEQ ID NO: 2), and wherein r is adenine or guanine and n is any nucleotide, the method comprising contacting the RNA transcript with a compound described herein (for example, a compound of Formula (I) or a form thereof or another splicing inducer).

In another embodiment, provided herein is a method for modulating the amount of an RNA transcript comprising a RNA nucleotide sequence, wherein the RNA nucleotide sequence comprises two exons and an intron, wherein one exon is upstream of the intron and the other exon is downstream of the intron, wherein the RNA nucleotide sequence of the intron comprises in 5' to 3' order: a first branch point, a first 3' splice site, and an iREMS, wherein the iREMS comprises an RNA sequence GAgurngn (SEQ ID NO: 2), and wherein r is adenine or guanine and n is any nucleotide, the method comprising contacting the RNA transcript with a compound described herein (for example, a compound of Formula (I) or a form thereof or another splicing inducer).

In another embodiment, provided herein is a method for modulating the amount of an RNA transcript comprising a RNA nucleotide sequence, wherein the RNA nucleotide sequence comprises two exons and an intron, and wherein the RNA nucleotide sequence comprises exonic and intronic elements illustrated in FIG. 1A, the method comprising contacting the RNA transcript with a compound described herein (for example, a compound of Formula (I) or a form thereof or another splicing inducer).

In another embodiment, provided herein is a method for modulating the amount of an RNA transcript comprising a RNA nucleotide sequence, wherein the RNA nucleotide sequence comprises two exons and an intron, and wherein the RNA nucleotide sequence comprises exonic and intronic elements illustrated in FIG. 1B, the method comprising contacting the RNA transcript with a compound described herein (for example, a compound of Formula (I) or a form thereof or another splicing inducer).

In another embodiment, provided herein is a method for modulating the amount of an RNA transcript comprising a RNA nucleotide sequence, wherein the RNA nucleotide sequence comprises three exons and two introns, and wherein the RNA nucleotide sequence comprises exonic and intronic elements illustrated in FIG. 1C, the method comprising contacting the RNA transcript with a compound described herein (for example, a compound of Formula (I) or a form thereof or another splicing inducer).

In a specific embodiment, the RNA transcript is the RNA transcript of a gene described in a table in this disclosure.

In another embodiment, provided herein is a method for modulating the amount of the product of a gene (such as an RNA transcript or a protein) in a subject, wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the iREMS comprises a DNA sequence GAgtrngn (SEQ ID NO: 4), and wherein r is adenine or guanine and n is any nucleotide, the method comprising administering a compound described herein (for example, a compound of Formula (I) or a form thereof or another splicing inducer) to the subject.

In another embodiment, provided herein is a method for modulating the amount of the product of a gene (such as an RNA transcript or protein) in a subject, wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence of the intron comprises in 5' to 3' order: a nucleotide sequence encoding a first branch point, a nucleotide sequence encoding a first 3' splice site, and a nucleotide sequence encoding an iREMS, wherein the iREMS comprises a DNA sequence GAgtrngn (SEQ ID NO: 4), and wherein r is adenine or guanine and n is any nucleotide, the method comprising administering a compound described herein (for example, a compound of Formula (I) or a form thereof or another splicing inducer) to the subject.

In another embodiment, provided herein is a method for modulating the amount of the product of a gene (such as an RNA transcript or protein) in a subject, wherein the gene comprises a DNA nucleotide sequence encoding two exons and an intron, and wherein the DNA nucleotide sequence comprises exonic and intronic elements illustrated in FIG. 1A, the method comprising administering a compound described herein (for example, a compound of Formula (I) or a form thereof or another splicing inducer) to the subject.

In another embodiment, provided herein is a method for modulating the amount of the product of a gene (such as an RNA transcript or protein) in a subject, wherein the gene comprises a DNA nucleotide sequence encoding two exons and an intron, and wherein the DNA nucleotide sequence comprises exonic and intronic elements illustrated in FIG. 1B, the method comprising administering a compound described herein (for example, a compound of Formula (I) or a form thereof or another splicing inducer) to the subject.

In another embodiment, provided herein is a method for modulating the amount of the product of a gene (such as an RNA transcript or protein) in a subject, wherein the gene comprises a DNA nucleotide sequence encoding two exons and an intron, and wherein the DNA nucleotide sequence comprises exonic and intronic elements illustrated in FIG. 1C, the method comprising administering a compound described herein (for example, a compound of Formula (I) or a form thereof or another splicing inducer) to the subject.

In a specific embodiment, the gene is a gene described in a table in this disclosure.

In another aspect, provided herein are methods for preventing and/or treating a disease associated with the aberrant expression of a product of a gene (e.g., an mRNA transcript or protein), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In one embodiment, provided herein are methods for preventing and/or treating a disease associated with aberrant expression of a product of a gene (e.g., an mRNA, RNA transcript or protein), by way of nonlimiting example, disclosed in Table 1, infra, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease associated with aberrant expression of a product of a gene (e.g., an mRNA, RNA transcript or protein), disclosed in Tables 2-7, infra, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease associated with aberrant expression of a product of a gene (e.g., an mRNA, RNA transcript or protein), by way of nonlimiting example, disclosed in International Patent Application No. PCT/US2014/071252 (International Publication No. WO 2015/105657), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease associated with aberrant expression of a product of a gene (e.g., an mRNA, RNA transcript or protein), by way of nonlimiting example, disclosed in International Patent Application No. PCT/US2016/034864 (International Publication No. WO 2016/196386), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease associated with aberrant expression of a product of a gene (e.g., an mRNA, RNA transcript or protein), disclosed in Table 1, infra, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease associated with aberrant expression of a product of a gene disclosed in Table 7, infra, (e.g., an mRNA, RNA transcript or protein), comprising administering to a human or non-human subject a compound of Formula (I) or a form thereof, or a pharmaceutical composition comprising a compound of Formula (I) or a form thereof and a pharmaceutically acceptable carrier, excipient or diluent. See the example section for additional information regarding the genes in Table 7. In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described infra. In some embodiments, a compound of Formula (I) is a compound selected from a compound described herein.

In another aspect, provided herein are methods for preventing and/or treating a disease in which a change in the level of expression of one, two, three or more RNA isoforms encoded by a gene is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In one embodiment, provided herein are methods for preventing and/or treating a disease in which the alteration (e.g., increase or decrease) in the expression one, two, three or more RNA isoforms encoded by a gene, by way of nonlimiting example, disclosed in Table 1, infra, is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another embodiment, provided herein are methods for preventing and/or treating a disease in which the alteration (e.g., increase or decrease) in the expression one, two, three or more RNA isoforms encoded by a gene, disclosed in Tables 2-7, infra, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another embodiment, provided herein are methods for preventing and/or treating a disease in which the alteration (e.g., increase or decrease) in the expression one, two, three or more RNA isoforms encoded by a gene, disclosed in International Patent Application No. PCT/US2014/071252 (International Publication No. WO 2015/105657), is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more RNA isoforms encoded by a gene, disclosed in International Patent Application No. PCT/US2016/034864 (International Publication No. WO 2016/196386), is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more RNA isoforms encoded by a gene, disclosed in Table 1, infra, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more RNA isoforms encoded by a gene disclosed in Table 1, infra, is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, one, two, three or more RNA isoforms encoded by a gene disclosed in Table 7, infra, are decreased following administration of a compound of Formula (I) or a form thereof and a pharmaceutically acceptable carrier, excipient or diluent. See the example section for additional information regarding the genes in Table 7. In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described infra. In some embodiments, a compound of Formula (I) is a compound selected from a compound described herein.

In another aspect, provided herein are methods for preventing and/or treating a disease in which a change in the level of expression of one, two, three or more protein isoforms encoded by a gene is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In one embodiment, provided herein are methods for preventing and/or treating a disease in which the alteration (e.g., increase or decrease) in the expression one, two, three or more protein isoforms encoded by a gene, by way of nonlimiting example, disclosed in Table 1, infra, is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another embodiment, provided herein are methods for preventing and/or treating a disease in which the alteration (e.g., increase or decrease) in the expression one, two, three or more protein isoforms encoded by a gene, disclosed in Tables 2-7, infra, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more protein isoforms encoded by a gene, disclosed in International Patent Application No. PCT/US2014/071252 (International Publication No. WO 2015/105657), is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more protein isoforms encoded by a gene, disclosed in International Patent Application No. PCT/US2016/034864 (International Publication No. WO 2016/196386), is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more protein isoforms encoded by a gene, disclosed in Table 1, infra, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent.

In another embodiment, provided herein are methods for preventing and/or treating a disease in which the alteration (e.g., increase or decrease) in the expression one, two, three or more protein isoforms encoded by a gene, disclosed in Table 1, infra, is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, one, two, three or more RNA isoforms encoded by a gene, disclosed in Table 7, infra, are decreased following administration of a compound of Formula (I) or a form thereof and a pharmaceutically acceptable carrier, excipient or diluent. See the example section for additional information regarding the genes in Table 7. In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described infra. In some embodiments, a compound of Formula (I) is a compound selected from a compound described herein.

In another embodiment, provided herein is a method for either preventing, treating or preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, a nucleotide sequence encoding an iREMS, a nucleotide sequence encoding a second branch point and a nucleotide sequence encoding a second 3' splice site, wherein the iREMS comprises a DNA sequence GAgtrngn (SEQ ID NO: 4), and wherein r is adenine or guanine and n is any nucleotide, the method comprising administering a compound described herein (for example, a compound of Formula (I) or a form thereof or another splicing inducer) to the subject.

In another embodiment, provided herein is a method for either preventing, treating or preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence of the intron comprises in 5' to 3' order: a nucleotide sequence encoding a first branch point, a nucleotide sequence encoding a first 3' splice site, and a nucleotide sequence encoding an iREMS, wherein the iREMS comprises a DNA sequence GAgtrngn (SEQ ID NO: 4), and wherein r is adenine or guanine and n is any nucleotide, the method comprising administering a compound described herein (for example, a compound of Formula (I) or a form thereof or another splicing inducer) to the subject.

In another embodiment, provided herein is a method for either preventing, treating or preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence comprises exonic and intronic elements illustrated in FIG. 1A, the method comprising administering a compound described herein (for example, a compound of Formula (I) or a form thereof or another splicing inducer) to the subject.

In another embodiment, provided herein is a method for either preventing, treating or preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence comprises exonic and intronic elements illustrated in FIG. 1B, the method comprising administering a compound described herein (for example, a compound of Formula (I) or a form thereof or another splicing inducer) to the subject.

In another embodiment, provided herein is a method for either preventing, treating or preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence comprises exonic and intronic elements illustrated in FIG. 1C, the method comprising administering a compound described herein (for example, a compound of Formula (I) or a form thereof or another splicing inducer) to the subject.

In a specific embodiment, the gene is a gene described in a table in this disclosure.

In another aspect, provided herein are artificial gene constructs. In one embodiment, provided herein is an artificial gene construct comprising endogenous DNA is modified to introduce a non-endogenous nucleotide sequence encoding an intron comprising a 3' splice site(s) and a branch point(s) and an intronic REMS. In another embodiment, provided herein is an artificial gene construct comprising DNA encoding exons and one, two or more introns, wherein a nucleotide sequence encoding an intronic REMS, functioning as a 5' splice site in the presence of a compound described herein, which may be upstream of an endogenous nucleotide sequence encoding a branch point and an endogenous nucleotide sequence encoding a 3' splice site, is modified to introduce a nucleotide sequence encoding a non-endogenous branch point and a non-endogenous 3' splice site further upstream from the endogenous intronic REMS. In another embodiment, provided herein is an artificial gene construct comprising DNA encoding exons and one, two or more introns, wherein a nucleotide sequence encoding an intronic REMS 5' splice site, which may be downstream of an endogenous nucleotide sequence encoding a branch point and an endogenous nucleotide sequence encoding a 3' splice site, is modified to introduce a nucleotide sequence encoding a non-endogenous branch point and a non-endogenous 3' splice site further downstream from the endogenous intronic REMS. In another embodiment, provided herein is an artificial gene construct comprising DNA encoding an intronic REMS, comprising nucleotides encoding an intronic REMS having one or more 5' splice site(s), 3' splice site(s) and branch point(s). In certain embodiments, the artificial gene construct encodes a frameshift or premature stop codon or internal insertions or deletions within the open reading frame. In other embodiments, the artificial gene construct encodes a mature mRNA having a functional open reading frame, producing a novel protein which may or may not be functional. In some embodiments, the artificial gene construct encodes a detectable reporter protein. RNA transcripts having a non-functional open reading frame due to the inclusion of a frameshift, premature stop codon or internal insertions or deletions within the open reading frame can be substrates for nonsense-mediated decay and thus have low abundance. Any intronic REMS-mediated alternative splicing modified RNA transcripts may also have altered stability, altered intracellular transport, altered 3' end formation efficiency and altered translation efficiency.

In a specific embodiment, the nucleotide sequence of the intronic REMS introduced into the nucleotide sequence of the artificial gene construct comprises the sequence NNGAgtrngn (SEQ ID NO: 3), wherein r is adenine or guanine and n or N is any nucleotide. In a specific embodiment, in the context of DNA, the nucleotide sequence encoding the intronic REMS comprises a sequence selected from the group consisting of ANGAgtrngn (SEQ ID NO: 1829), CNGAgtrngn (SEQ ID NO: 1835), GNGAgtrngn (SEQ ID NO: 1841), TNGAgtrngn (SEQ ID NO: 1847), NAGAgtrngn (SEQ ID NO: 1830), NCGAgtrngn (SEQ ID NO: 1836), NGGAgtrngn (SEQ ID NO: 1842), NTGAgtrngn (SEQ ID NO: 1848), AAGAgtrngn (SEQ ID NO: 1831), ACGAgtrngn (SEQ ID NO: 1837), AGGAgtrngn (SEQ ID NO: 1843), ATGAgtrngn (SEQ ID NO: 1849), CAGAgtrngn (SEQ ID NO: 1832), CCGAgtrngn (SEQ ID NO: 1838), CGGAgtrngn (SEQ ID NO: 1844), CTGAgtrngn (SEQ ID NO: 1850), GAGAgtrngn (SEQ ID NO: 1833), GCGAgtrngn (SEQ ID NO: 1839), GGGAgtrngn (SEQ ID NO: 1845), GTGAgtrngn (SEQ ID NO: 1851), TAGAgtrngn (SEQ ID NO: 1834), TCGAgtrngn (SEQ ID NO: 1840), TGGAgtrngn (SEQ ID NO: 1846) and TTGAgtrngn (SEQ ID NO: 1852), wherein r is adenine or guanine and n or N is any nucleotide.

In a further specific embodiment, in the context of DNA, the nucleotide sequence encoding the intronic REMS comprises a sequence selected from the group consisting of ANGAgtragt (SEQ ID NO: 2237), CNGAgtragt (SEQ ID NO: 2243), GNGAgtragt (SEQ ID NO: 2249), TNGAgtragt (SEQ ID NO: 2255), NAGAgtragt (SEQ ID NO: 2238), NCGAgtragt (SEQ ID NO: 2244), NGGAgtragt (SEQ ID NO: 2250), NTGAgtragt (SEQ ID NO: 2256), AAGAgtragt (SEQ ID NO: 2239), ACGAgtragt (SEQ ID NO: 2245), AGGAgtragt (SEQ ID NO: 2251), ATGAgtragt (SEQ ID NO: 2257), CAGAgtragt (SEQ ID NO: 2240), CCGAgtragt (SEQ ID NO: 2246), CGGAgtragt (SEQ ID NO: 2252), CTGAgtragt (SEQ ID NO: 2258), GAGAgtragt (SEQ ID NO: 2241), GCGAgtragt (SEQ ID NO: 2247), GGGAgtragt (SEQ ID NO: 2253), GTGAgtragt (SEQ ID NO: 2259), TAGAgtragt (SEQ ID NO: 2242), TCGAgtragt (SEQ ID NO: 2248), TGGAgtragt (SEQ ID NO: 2254) and TTGAgtragt (SEQ ID NO: 2260), wherein r is adenine or guanine and N is any nucleotide. In one or more embodiments provided herein, N is adenine or guanine. In various specific embodiments, the nucleotide sequence encoding the intronic REMS is a nucleotide sequence encoding a non-endogenous intronic REMS, i.e., a precursor RNA transcript comprising the non-endogenous intronic REMS not naturally found in the DNA sequence of the artificial construct.

In a specific embodiment, the intronic REMS referred to in a method or artificial gene construct described herein comprises, at the DNA level, a sequence presented in the following table (wherein r is adenine or guanine, and n or N is any nucleotide):

TABLE 14

Intronic REMS DNA sequence (wherein r is adenine or guanine, and n or N is any nucleotide)

| SEQ ID NO. | Sequence |
|---|---|
| 1829 | ANGAgtrngn |
| 1830 | NAGAgtrngn |
| 1831 | AAGAgtrngn |
| 1832 | CAGAgtrngn |
| 1833 | GAGAgtrngn |
| 1834 | TAGAgtrngn |
| 1835 | CNGAgtrngn |
| 1836 | NCGAgtrngn |
| 1837 | ACGAgtrngn |
| 1838 | CCGAgtrngn |
| 1839 | GCGAgtrngn |
| 1840 | TCGAgtrngn |
| 1841 | GNGAgtrngn |
| 1842 | NGGAgtrngn |
| 1843 | AGGAgtrngn |
| 1844 | CGGAgtrngn |
| 1845 | GGGAgtrngn |
| 1846 | TGGAgtrngn |
| 1847 | TNGAgtrngn |
| 1848 | NTGAgtrngn |
| 1849 | ATGAgtrngn |
| 1850 | CTGAgtrngn |
| 1851 | GTGAgtrngn |
| 1852 | TTGAgtrngn |
| 1853 | ANGAgtragn |
| 1854 | NAGAgtragn |
| 1855 | AAGAgtragn |
| 1856 | CAGAgtragn |
| 1857 | GAGAgtragn |

TABLE 14-continued

Intronic REMS DNA sequence (wherein r is adenine or guanine, and n or N is any nucleotide)

| SEQ ID NO. | Sequence |
|---|---|
| 1858 | TAGAgtragn |
| 1859 | CNGAgtragn |
| 1860 | NCGAgtragn |
| 1861 | ACGAgtragn |
| 1862 | CCGAgtragn |
| 1863 | GCGAgtragn |
| 1864 | TCGAgtragn |
| 1865 | GNGAgtragn |
| 1866 | NGGAgtragn |
| 1867 | AGGAgtragn |
| 1868 | CGGAgtragn |
| 1869 | GGGAgtragn |
| 1870 | TGGAgtragn |
| 1871 | TNGAgtragn |
| 1872 | NTGAgtragn |
| 1873 | ATGAgtragn |
| 1874 | CTGAgtragn |
| 1875 | GTGAgtragn |
| 1876 | TTGAgtragn |
| 1877 | ANGAgtrcgn |
| 1878 | NAGAgtrcgn |
| 1879 | AAGAgtrcgn |
| 1880 | CAGAgtrcgn |
| 1881 | GAGAgtrcgn |
| 1882 | TAGAgtrcgn |
| 1883 | CNGAgtrcgn |
| 1884 | NCGAgtrcgn |
| 1885 | ACGAgtrcgn |
| 1886 | CCGAgtrcgn |
| 1887 | GCGAgtrcgn |
| 1888 | TCGAgtrcgn |
| 1889 | GNGAgtrcgn |
| 1890 | NGGAgtrcgn |
| 1891 | AGGAgtrcgn |
| 1892 | CGGAgtrcgn |
| 1893 | GGGAgtrcgn |
| 1894 | TGGAgtrcgn |
| 1895 | TNGAgtrcgn |
| 1896 | NTGAgtrcgn |
| 1897 | ATGAgtrcgn |
| 1898 | CTGAgtrcgn |
| 1899 | GTGAgtrcgn |
| 1900 | TTGAgtrcgn |
| 1901 | ANGAgtrggn |
| 1902 | NAGAgtrggn |
| 1903 | AAGAgtrggn |
| 1904 | CAGAgtrggn |
| 1905 | GAGAgtrggn |
| 1906 | TAGAgtrggn |
| 1907 | CNGAgtrggn |
| 1908 | NCGAgtrggn |
| 1909 | ACGAgtrggn |
| 1910 | CCGAgtrggn |
| 1911 | GCGAgtrggn |
| 1912 | TCGAgtrggn |
| 1913 | GNGAgtrggn |
| 1914 | NGGAgtrggn |
| 1915 | AGGAgtrggn |
| 1916 | CGGAgtrggn |
| 1917 | GGGAgtrggn |
| 1918 | TGGAgtrggn |
| 1919 | TNGAgtrggn |
| 1920 | NTGAgtrggn |
| 1921 | ATGAgtrggn |
| 1922 | CTGAgtrggn |
| 1923 | GTGAgtrggn |
| 1924 | TTGAgtrggn |
| 1925 | ANGAgtrtgn |
| 1926 | NAGAgtrtgn |
| 1927 | AAGAgtrtgn |
| 1928 | CAGAgtrtgn |
| 1929 | GAGAgtrtgn |
| 1930 | TAGAgtrtgn |
| 1931 | CNGAgtrtgn |

TABLE 14-continued

Intronic REMS DNA sequence (wherein r is adenine or guanine, and n or N is any nucleotide)

| SEQ ID NO. | Sequence |
|---|---|
| 1932 | NCGAgtrtgn |
| 1933 | ACGAgtrtgn |
| 1934 | CCGAgtrtgn |
| 1935 | GCGAgtrtgn |
| 1936 | TCGAgtrtgn |
| 1937 | GNGAgtrtgn |
| 1938 | NGGAgtrtgn |
| 1939 | AGGAgtrtgn |
| 1940 | CGGAgtrtgn |
| 1941 | GGGAgtrtgn |
| 1942 | TGGAgtrtgn |
| 1943 | TNGAgtrtgn |
| 1944 | NTGAgtrtgn |
| 1945 | ATGAgtrtgn |
| 1946 | CTGAgtrtgn |
| 1947 | GTGAgtrtgn |
| 1948 | TTGAgtrtgn |
| 1949 | ANGAgtraga |
| 1950 | NAGAgtraga |
| 1951 | AAGAgtraga |
| 1952 | CAGAgtraga |
| 1953 | GAGAgtraga |
| 1954 | TAGAgtraga |
| 1955 | CNGAgtraga |
| 1956 | NCGAgtraga |
| 1957 | ACGAgtraga |
| 1958 | CCGAgtraga |
| 1959 | GCGAgtraga |
| 1960 | TCGAgtraga |
| 1961 | GNGAgtraga |
| 1962 | NGGAgtraga |
| 1963 | AGGAgtraga |
| 1964 | CGGAgtraga |
| 1965 | GGGAgtraga |
| 1966 | TGGAgtraga |
| 1967 | TNGAgtraga |
| 1968 | NTGAgtraga |
| 1969 | ATGAgtraga |
| 1970 | CTGAgtraga |
| 1971 | GTGAgtraga |
| 1972 | TTGAgtraga |
| 1973 | ANGAgtrcga |
| 1974 | NAGAgtrcga |
| 1975 | AAGAgtrcga |
| 1976 | CAGAgtrcga |
| 1977 | GAGAgtrcga |
| 1978 | TAGAgtrcga |
| 1979 | CNGAgtrcga |
| 1980 | NCGAgtrcga |
| 1981 | ACGAgtrcga |
| 1982 | CCGAgtrcga |
| 1983 | GCGAgtrcga |
| 1984 | TCGAgtrcga |
| 1985 | GNGAgtrcga |
| 1986 | NGGAgtrcga |
| 1987 | AGGAgtrcga |
| 1988 | CGGAgtrcga |
| 1989 | GGGAgtrcga |
| 1990 | TGGAgtrcga |
| 1991 | TNGAgtrcga |
| 1992 | NTGAgtrcga |
| 1993 | ATGAgtrcga |
| 1994 | CTGAgtrcga |
| 1995 | GTGAgtrcga |
| 1996 | TTGAgtrcga |
| 1997 | ANGAgtrgga |
| 1998 | NAGAgtrgga |
| 1999 | AAGAgtrgga |
| 2000 | CAGAgtrgga |
| 2001 | GAGAgtrgga |
| 2002 | TAGAgtrgga |
| 2003 | CNGAgtrgga |
| 2004 | NCGAgtrgga |
| 2005 | ACGAgtrgga |

TABLE 14-continued

Intronic REMS DNA sequence (wherein r is adenine or guanine, and n or N is any nucleotide)

| SEQ ID NO. | Sequence |
|---|---|
| 2006 | CCGAgtrgga |
| 2007 | GCGAgtrgga |
| 2008 | TCGAgtrgga |
| 2009 | GNGAgtrgga |
| 2010 | NGGAgtrgga |
| 2011 | AGGAgtrgga |
| 2012 | CGGAgtrgga |
| 2013 | GGGAgtrgga |
| 2014 | TGGAgtrgga |
| 2015 | TNGAgtrgga |
| 2016 | NTGAgtrgga |
| 2017 | ATGAgtrgga |
| 2018 | CTGAgtrgga |
| 2019 | GTGAgtrgga |
| 2020 | TTGAgtrgga |
| 2021 | ANGAgtrtga |
| 2022 | NAGAgtrtga |
| 2023 | AAGAgtrtga |
| 2024 | CAGAgtrtga |
| 2025 | GAGAgtrtga |
| 2026 | TAGAgtrtga |
| 2027 | CNGAgtrtga |
| 2028 | NCGAgtrtga |
| 2029 | ACGAgtrtga |
| 2030 | CCGAgtrtga |
| 2031 | GCGAgtrtga |
| 2032 | TCGAgtrtga |
| 2033 | GNGAgtrtga |
| 2034 | NGGAgtrtga |
| 2035 | AGGAgtrtga |
| 2036 | CGGAgtrtga |
| 2037 | GGGAgtrtga |
| 2038 | TGGAgtrtga |
| 2039 | TNGAgtrtga |
| 2040 | NTGAgtrtga |
| 2041 | ATGAgtrtga |
| 2042 | CTGAgtrtga |
| 2043 | GTGAgtrtga |
| 2044 | TTGAgtrtga |
| 2045 | ANGAgtragc |
| 2046 | NAGAgtragc |
| 2047 | AAGAgtragc |
| 2048 | CAGAgtragc |
| 2049 | GAGAgtragc |
| 2050 | TAGAgtragc |
| 2051 | CNGAgtragc |
| 2052 | NCGAgtragc |
| 2053 | ACGAgtragc |
| 2054 | CCGAgtragc |
| 2055 | GCGAgtragc |
| 2056 | TCGAgtragc |
| 2057 | GNGAgtragc |
| 2058 | NGGAgtragc |
| 2059 | AGGAgtragc |
| 2060 | CGGAgtragc |
| 2061 | GGGAgtragc |
| 2062 | TGGAgtragc |
| 2063 | TNGAgtragc |
| 2064 | NTGAgtragc |
| 2065 | ATGAgtragc |
| 2066 | CTGAgtragc |
| 2067 | GTGAgtragc |
| 2068 | TTGAgtragc |
| 2069 | ANGAgtrcgc |
| 2070 | NAGAgtrcgc |
| 2071 | AAGAgtrcgc |
| 2072 | CAGAgtrcgc |
| 2073 | GAGAgtrcgc |
| 2074 | TAGAgtrcgc |
| 2075 | CNGAgtrcgc |
| 2076 | NCGAgtrcgc |
| 2077 | ACGAgtrcgc |
| 2078 | CCGAgtrcgc |
| 2079 | GCGAgtrcgc |

TABLE 14-continued

Intronic REMS DNA sequence (wherein r is adenine or guanine, and n or N is any nucleotide)

| SEQ ID NO. | Sequence |
|---|---|
| 2080 | TCGAgtrcgc |
| 2081 | GNGAgtrcgc |
| 2082 | NGGAgtrcgc |
| 2083 | AGGAgtrcgc |
| 2084 | CGGAgtrcgc |
| 2085 | GGGAgtrcgc |
| 2086 | TGGAgtrcgc |
| 2087 | TNGAgtrcgc |
| 2088 | NTGAgtrcgc |
| 2089 | ATGAgtrcgc |
| 2090 | CTGAgtrcgc |
| 2091 | GTGAgtrcgc |
| 2092 | TTGAgtrcgc |
| 2093 | ANGAgtrggc |
| 2094 | NAGAgtrggc |
| 2095 | AAGAgtrggc |
| 2096 | CAGAgtrggc |
| 2097 | GAGAgtrggc |
| 2098 | TAGAgtrggc |
| 2099 | CNGAgtrggc |
| 2100 | NCGAgtrggc |
| 2101 | ACGAgtrggc |
| 2102 | CCGAgtrggc |
| 2103 | GCGAgtrggc |
| 2104 | TCGAgtrggc |
| 2105 | GNGAgtrggc |
| 2106 | NGGAgtrggc |
| 2107 | AGGAgtrggc |
| 2108 | CGGAgtrggc |
| 2109 | GGGAgtrggc |
| 2110 | TGGAgtrggc |
| 2111 | TNGAgtrggc |
| 2112 | NTGAgtrggc |
| 2113 | ATGAgtrggc |
| 2114 | CTGAgtrggc |
| 2115 | GTGAgtrggc |
| 2116 | TTGAgtrggc |
| 2117 | ANGAgtrtgc |
| 2118 | NAGAgtrtgc |
| 2119 | AAGAgtrtgc |
| 2120 | CAGAgtrtgc |
| 2121 | GAGAgtrtgc |
| 2122 | TAGAgtrtgc |
| 2123 | CNGAgtrtgc |
| 2124 | NCGAgtrtgc |
| 2125 | ACGAgtrtgc |
| 2126 | CCGAgtrtgc |
| 2127 | GCGAgtrtgc |
| 2128 | TCGAgtrtgc |
| 2129 | GNGAgtrtgc |
| 2130 | NGGAgtrtgc |
| 2131 | AGGAgtrtgc |
| 2132 | CGGAgtrtgc |
| 2133 | GGGAgtrtgc |
| 2134 | TGGAgtrtgc |
| 2135 | TNGAgtrtgc |
| 2136 | NTGAgtrtgc |
| 2137 | ATGAgtrtgc |
| 2138 | CTGAgtrtgc |
| 2139 | GTGAgtrtgc |
| 2140 | TTGAgtrtgc |
| 2141 | ANGAgtragg |
| 2142 | NAGAgtragg |
| 2143 | AAGAgtragg |
| 2144 | CAGAgtragg |
| 2145 | GAGAgtragg |
| 2146 | TAGAgtragg |
| 2147 | CNGAgtragg |
| 2148 | NCGAgtragg |
| 2149 | ACGAgtragg |
| 2150 | CCGAgtragg |
| 2151 | GCGAgtragg |
| 2152 | TCGAgtragg |
| 2153 | GNGAgtragg |

TABLE 14-continued

Intronic REMS DNA sequence (wherein r is adenine or guanine, and n or N is any nucleotide)

| SEQ ID NO. | Sequence |
|---|---|
| 2154 | NGGAgtragg |
| 2155 | AGGAgtragg |
| 2156 | CGGAgtragg |
| 2157 | GGGAgtragg |
| 2158 | TGGAgtragg |
| 2159 | TNGAgtragg |
| 2160 | NTGAgtragg |
| 2161 | ATGAgtragg |
| 2162 | CTGAgtragg |
| 2163 | GTGAgtragg |
| 2164 | TTGAgtragg |
| 2165 | ANGAgtrcgg |
| 2166 | NAGAgtrcgg |
| 2167 | AAGAgtrcgg |
| 2168 | CAGAgtrcgg |
| 2169 | GAGAgtrcgg |
| 2170 | TAGAgtrcgg |
| 2171 | CNGAgtrcgg |
| 2172 | NCGAgtrcgg |
| 2173 | ACGAgtrcgg |
| 2174 | CCGAgtrcgg |
| 2175 | GCGAgtrcgg |
| 2176 | TCGAgtrcgg |
| 2177 | GNGAgtrcgg |
| 2178 | NGGAgtrcgg |
| 2179 | AGGAgtrcgg |
| 2180 | CGGAgtrcgg |
| 2181 | GGGAgtrcgg |
| 2182 | TGGAgtrcgg |
| 2183 | TNGAgtrcgg |
| 2184 | NTGAgtrcgg |
| 2185 | ATGAgtrcgg |
| 2186 | CTGAgtrcgg |
| 2187 | GTGAgtrcgg |
| 2188 | TTGAgtrcgg |
| 2189 | ANGAgtrggg |
| 2190 | NAGAgtrggg |
| 2191 | AAGAgtrggg |
| 2192 | CAGAgtrggg |
| 2193 | GAGAgtrggg |
| 2194 | TAGAgtrggg |
| 2195 | CNGAgtrggg |
| 2196 | NCGAgtrggg |
| 2197 | ACGAgtrggg |
| 2198 | CCGAgtrggg |
| 2199 | GCGAgtrggg |
| 2200 | TCGAgtrggg |
| 2201 | GNGAgtrggg |
| 2202 | NGGAgtrggg |
| 2203 | AGGAgtrggg |
| 2204 | CGGAgtrggg |
| 2205 | GGGAgtrggg |
| 2206 | TGGAgtrggg |
| 2207 | TNGAgtrggg |
| 2208 | NTGAgtrggg |
| 2209 | ATGAgtrggg |
| 2210 | CTGAgtrggg |
| 2211 | GTGAgtrggg |
| 2212 | TTGAgtrggg |
| 2213 | ANGAgtrtgg |
| 2214 | NAGAgtrtgg |
| 2215 | AAGAgtrtgg |
| 2216 | CAGAgtrtgg |
| 2217 | GAGAgtrtgg |
| 2218 | TAGAgtrtgg |
| 2219 | CNGAgtrtgg |
| 2220 | NCGAgtrtgg |
| 2221 | ACGAgtrtgg |
| 2222 | CCGAgtrtgg |
| 2223 | GCGAgtrtgg |
| 2224 | TCGAgtrtgg |
| 2225 | GNGAgtrtgg |
| 2226 | NGGAgtrtgg |
| 2227 | AGGAgtrtgg |

TABLE 14-continued

Intronic REMS DNA sequence (wherein r is adenine or guanine, and n or N is any nucleotide)

| SEQ ID NO. | Sequence |
|---|---|
| 2228 | CGGAgtrtgg |
| 2229 | GGGAgtrtgg |
| 2230 | TGGAgtrtgg |
| 2231 | TNGAgtrtgg |
| 2232 | NTGAgtrtgg |
| 2233 | ATGAgtrtgg |
| 2234 | CTGAgtrtgg |
| 2235 | GTGAgtrtgg |
| 2236 | TTGAgtrtgg |
| 2237 | ANGAgtragt |
| 2238 | NAGAgtragt |
| 2239 | AAGAgtragt |
| 2240 | CAGAgtragt |
| 2241 | GAGAgtragt |
| 2242 | TAGAgtragt |
| 2243 | CNGAgtragt |
| 2244 | NCGAgtragt |
| 2245 | ACGAgtragt |
| 2246 | CCGAgtragt |
| 2247 | GCGAgtragt |
| 2248 | TCGAgtragt |
| 2249 | GNGAgtragt |
| 2250 | NGGAgtragt |
| 2251 | AGGAgtragt |
| 2252 | CGGAgtragt |
| 2253 | GGGAgtragt |
| 2254 | TGGAgtragt |
| 2255 | TNGAgtragt |
| 2256 | NTGAgtragt |
| 2257 | ATGAgtragt |
| 2258 | CTGAgtragt |
| 2259 | GTGAgtragt |
| 2260 | TTGAgtragt |
| 2261 | ANGAgtrcgt |
| 2262 | NAGAgtrcgt |
| 2263 | AAGAgtrcgt |
| 2264 | CAGAgtrcgt |
| 2265 | GAGAgtrcgt |
| 2266 | TAGAgtrcgt |
| 2267 | CNGAgtrcgt |
| 2268 | NCGAgtrcgt |
| 2269 | ACGAgtrcgt |
| 2270 | CCGAgtrcgt |
| 2271 | GCGAgtrcgt |
| 2272 | TCGAgtrcgt |
| 2273 | GNGAgtrcgt |
| 2274 | NGGAgtrcgt |
| 2275 | AGGAgtrcgt |
| 2276 | CGGAgtrcgt |
| 2277 | GGGAgtrcgt |
| 2278 | TGGAgtrcgt |
| 2279 | TNGAgtrcgt |
| 2280 | NTGAgtrcgt |
| 2281 | ATGAgtrcgt |
| 2282 | CTGAgtrcgt |
| 2283 | GTGAgtrcgt |
| 2284 | TTGAgtrcgt |
| 2285 | ANGAgtrggt |
| 2286 | NAGAgtrggt |
| 2287 | AAGAgtrggt |
| 2288 | CAGAgtrggt |
| 2289 | GAGAgtrggt |
| 2290 | TAGAgtrggt |
| 2291 | CNGAgtrggt |
| 2292 | NCGAgtrggt |
| 2293 | ACGAgtrggt |
| 2294 | CCGAgtrggt |
| 2295 | GCGAgtrggt |
| 2296 | TCGAgtrggt |
| 2297 | GNGAgtrggt |
| 2298 | NGGAgtrggt |
| 2299 | AGGAgtrggt |
| 2300 | CGGAgtrggt |
| 2301 | GGGAgtrggt |

TABLE 14-continued

Intronic REMS DNA sequence (wherein r is adenine or guanine, and n or N is any nucleotide)

| SEQ ID NO. | Sequence |
|---|---|
| 2302 | TGGAgtrggt |
| 2303 | TNGAgtrggt |
| 2304 | NTGAgtrggt |
| 2305 | ATGAgtrggt |
| 2306 | CTGAgtrggt |
| 2307 | GTGAgtrggt |
| 2308 | TTGAgtrggt |
| 2309 | ANGAgtrtgt |
| 2310 | NAGAgtrtgt |
| 2311 | AAGAgtrtgt |
| 2312 | CAGAgtrtgt |
| 2313 | GAGAgtrtgt |
| 2314 | TAGAgtrtgt |
| 2315 | CNGAgtrtgt |
| 2316 | NCGAgtrtgt |
| 2317 | ACGAgtrtgt |
| 2318 | CCGAgtrtgt |
| 2319 | GCGAgtrtgt |
| 2320 | TCGAgtrtgt |
| 2321 | GNGAgtrtgt |
| 2322 | NGGAgtrtgt |
| 2323 | AGGAgtrtgt |
| 2324 | CGGAgtrtgt |
| 2325 | GGGAgtrtgt |
| 2326 | TGGAgtrtgt |
| 2327 | TNGAgtrtgt |
| 2328 | NTGAgtrtgt |
| 2329 | ATGAgtrtgt |
| 2330 | CTGAgtrtgt |
| 2331 | GTGAgtrtgt |
| 2332 | TTGAgtrtgt |
| 2333 | ANGAgtrnga |
| 2334 | NAGAgtrnga |
| 2335 | AAGAgtrnga |
| 2336 | CAGAgtrnga |
| 2337 | GAGAgtrnga |
| 2338 | TAGAgtrnga |
| 2339 | CNGAgtrnga |
| 2340 | NCGAgtrnga |
| 2341 | ACGAgtrnga |
| 2342 | CCGAgtrnga |
| 2343 | GCGAgtrnga |
| 2344 | TCGAgtrnga |
| 2345 | GNGAgtrnga |
| 2346 | NGGAgtrnga |
| 2347 | AGGAgtrnga |
| 2348 | CGGAgtrnga |
| 2349 | GGGAgtrnga |
| 2350 | TGGAgtrnga |
| 2351 | TNGAgtrnga |
| 2352 | NTGAgtrnga |
| 2353 | ATGAgtrnga |
| 2354 | CTGAgtrnga |
| 2355 | GTGAgtrnga |
| 2356 | TTGAgtrnga |
| 2357 | ANGAgtrngc |
| 2358 | NAGAgtrngc |
| 2359 | AAGAgtrngc |
| 2360 | CAGAgtrngc |
| 2361 | GAGAgtrngc |
| 2362 | TAGAgtrngc |
| 2363 | CNGAgtrngc |
| 2364 | NCGAgtrngc |
| 2365 | ACGAgtrngc |
| 2366 | CCGAgtrngc |
| 2367 | GCGAgtrngc |
| 2368 | TCGAgtrngc |
| 2369 | GNGAgtrngc |
| 2370 | NGGAgtrngc |
| 2371 | AGGAgtrngc |
| 2372 | CGGAgtrngc |
| 2373 | GGGAgtrngc |
| 2374 | TGGAgtrngc |
| 2375 | TNGAgtrngc |

TABLE 14-continued

Intronic REMS DNA sequence (wherein r is adenine or guanine, and n or N is any nucleotide)

| SEQ ID NO. | Sequence |
|---|---|
| 2376 | NTGAgtrngc |
| 2377 | ATGAgtrngc |
| 2378 | CTGAgtrngc |
| 2379 | GTGAgtrngc |
| 2380 | TTGAgtrngc |
| 2381 | ANGAgtrngg |
| 2382 | NAGAgtrngg |
| 2383 | AAGAgtrngg |
| 2384 | CAGAgtrngg |
| 2385 | GAGAgtrngg |
| 2386 | TAGAgtrngg |
| 2387 | CNGAgtrngg |
| 2388 | NCGAgtrngg |
| 2389 | ACGAgtrngg |
| 2390 | CCGAgtrngg |
| 2391 | GCGAgtrngg |
| 2392 | TCGAgtrngg |
| 2393 | GNGAgtrngg |
| 2394 | NGGAgtrngg |
| 2395 | AGGAgtrngg |
| 2396 | CGGAgtrngg |
| 2397 | GGGAgtrngg |
| 2398 | TGGAgtrngg |
| 2399 | TNGAgtrngg |
| 2400 | NTGAgtrngg |
| 2401 | ATGAgtrngg |
| 2402 | CTGAgtrngg |
| 2403 | GTGAgtrngg |
| 2404 | TTGAgtrngg |
| 2405 | ANGAgtrngt |
| 2406 | NAGAgtrngt |
| 2407 | AAGAgtrngt |
| 2408 | CAGAgtrngt |
| 2409 | GAGAgtrngt |
| 2410 | TAGAgtrngt |
| 2411 | CNGAgtrngt |
| 2412 | NCGAgtrngt |
| 2413 | ACGAgtrngt |
| 2414 | CCGAgtrngt |
| 2415 | GCGAgtrngt |
| 2416 | TCGAgtrngt |
| 2417 | GNGAgtrngt |
| 2418 | NGGAgtrngt |
| 2419 | AGGAgtrngt |
| 2420 | CGGAgtrngt |
| 2421 | GGGAgtrngt |
| 2422 | TGGAgtrngt |
| 2423 | TNGAgtrngt |
| 2424 | NTGAgtrngt |
| 2425 | ATGAgtrngt |
| 2426 | CTGAgtrngt |
| 2427 | GTGAgtrngt |
| 2428 | TTGAgtrngt |
| 2429 | ANGAgtangn |
| 2430 | NAGAgtangn |
| 2431 | AAGAgtangn |
| 2432 | CAGAgtangn |
| 2433 | GAGAgtangn |
| 2434 | TAGAgtangn |
| 2435 | CNGAgtangn |
| 2436 | NCGAgtangn |
| 2437 | ACGAgtangn |
| 2438 | CCGAgtangn |
| 2439 | GCGAgtangn |
| 2440 | TCGAgtangn |
| 2441 | GNGAgtangn |
| 2442 | NGGAgtangn |
| 2443 | AGGAgtangn |
| 2444 | CGGAgtangn |
| 2445 | GGGAgtangn |
| 2446 | TGGAgtangn |
| 2447 | TNGAgtangn |
| 2448 | NTGAgtangn |
| 2449 | ATGAgtangn |

TABLE 14-continued

Intronic REMS DNA sequence (wherein r is adenine or guanine, and n or N is any nucleotide)

| SEQ ID NO. | Sequence |
|---|---|
| 2450 | CTGAgtangn |
| 2451 | GTGAgtangn |
| 2452 | TTGAgtangn |
| 2453 | ANGAgtaagn |
| 2454 | NAGAgtaagn |
| 2455 | AAGAgtaagn |
| 2456 | CAGAgtaagn |
| 2457 | GAGAgtaagn |
| 2458 | TAGAgtaagn |
| 2459 | CNGAgtaagn |
| 2460 | NCGAgtaagn |
| 2461 | ACGAgtaagn |
| 2462 | CCGAgtaagn |
| 2463 | GCGAgtaagn |
| 2464 | TCGAgtaagn |
| 2465 | GNGAgtaagn |
| 2466 | NGGAgtaagn |
| 2467 | AGGAgtaagn |
| 2468 | CGGAgtaagn |
| 2469 | GGGAgtaagn |
| 2470 | TGGAgtaagn |
| 2471 | TNGAgtaagn |
| 2472 | NTGAgtaagn |
| 2473 | ATGAgtaagn |
| 2474 | CTGAgtaagn |
| 2475 | GTGAgtaagn |
| 2476 | TTGAgtaagn |
| 2477 | ANGAgtacgn |
| 2478 | NAGAgtacgn |
| 2479 | AAGAgtacgn |
| 2480 | CAGAgtacgn |
| 2481 | GAGAgtacgn |
| 2482 | TAGAgtacgn |
| 2483 | CNGAgtacgn |
| 2484 | NCGAgtacgn |
| 2485 | ACGAgtacgn |
| 2486 | CCGAgtacgn |
| 2487 | GCGAgtacgn |
| 2488 | TCGAgtacgn |
| 2489 | GNGAgtacgn |
| 2490 | NGGAgtacgn |
| 2491 | AGGAgtacgn |
| 2492 | CGGAgtacgn |
| 2493 | GGGAgtacgn |
| 2494 | TGGAgtacgn |
| 2495 | TNGAgtacgn |
| 2496 | NTGAgtacgn |
| 2497 | ATGAgtacgn |
| 2498 | CTGAgtacgn |
| 2499 | GTGAgtacgn |
| 2500 | TTGAgtacgn |
| 2501 | ANGAgtaggn |
| 2502 | NAGAgtaggn |
| 2503 | AAGAgtaggn |
| 2504 | CAGAgtaggn |
| 2505 | GAGAgtaggn |
| 2506 | TAGAgtaggn |
| 2507 | CNGAgtaggn |
| 2508 | NCGAgtaggn |
| 2509 | ACGAgtaggn |
| 2510 | CCGAgtaggn |
| 2511 | GCGAgtaggn |
| 2512 | TCGAgtaggn |
| 2513 | GNGAgtaggn |
| 2514 | NGGAgtaggn |
| 2515 | AGGAgtaggn |
| 2516 | CGGAgtaggn |
| 2517 | GGGAgtaggn |
| 2518 | TGGAgtaggn |
| 2519 | TNGAgtaggn |
| 2520 | NTGAgtaggn |
| 2521 | ATGAgtaggn |
| 2522 | CTGAgtaggn |
| 2523 | GTGAgtaggn |

TABLE 14-continued

Intronic REMS DNA sequence (wherein r is adenine or guanine, and n or N is any nucleotide)

| SEQ ID NO. | Sequence |
|---|---|
| 2524 | TTGAgtaggn |
| 2525 | ANGAgtatgn |
| 2526 | NAGAgtatgn |
| 2527 | AAGAgtatgn |
| 2528 | CAGAgtatgn |
| 2529 | GAGAgtatgn |
| 2530 | TAGAgtatgn |
| 2531 | CNGAgtatgn |
| 2532 | NCGAgtatgn |
| 2533 | ACGAgtatgn |
| 2534 | CCGAgtatgn |
| 2535 | GCGAgtatgn |
| 2536 | TCGAgtatgn |
| 2537 | GNGAgtatgn |
| 2538 | NGGAgtatgn |
| 2539 | AGGAgtatgn |
| 2540 | CGGAgtatgn |
| 2541 | GGGAgtatgn |
| 2542 | TGGAgtatgn |
| 2543 | TNGAgtatgn |
| 2544 | NTGAgtatgn |
| 2545 | ATGAgtatgn |
| 2546 | CTGAgtatgn |
| 2547 | GTGAgtatgn |
| 2548 | TTGAgtatgn |
| 2549 | ANGAgtaaga |
| 2550 | NAGAgtaaga |
| 2551 | AAGAgtaaga |
| 2552 | CAGAgtaaga |
| 2553 | GAGAgtaaga |
| 2554 | TAGAgtaaga |
| 2555 | CNGAgtaaga |
| 2556 | NCGAgtaaga |
| 2557 | ACGAgtaaga |
| 2558 | CCGAgtaaga |
| 2559 | GCGAgtaaga |
| 2560 | TCGAgtaaga |
| 2561 | GNGAgtaaga |
| 2562 | NGGAgtaaga |
| 2563 | AGGAgtaaga |
| 2564 | CGGAgtaaga |
| 2565 | GGGAgtaaga |
| 2566 | TGGAgtaaga |
| 2567 | TNGAgtaaga |
| 2568 | NTGAgtaaga |
| 2569 | ATGAgtaaga |
| 2570 | CTGAgtaaga |
| 2571 | GTGAgtaaga |
| 2572 | TTGAgtaaga |
| 2573 | ANGAgtacga |
| 2574 | NAGAgtacga |
| 2575 | AAGAgtacga |
| 2576 | CAGAgtacga |
| 2577 | GAGAgtacga |
| 2578 | TAGAgtacga |
| 2579 | CNGAgtacga |
| 2580 | NCGAgtacga |
| 2581 | ACGAgtacga |
| 2582 | CCGAgtacga |
| 2583 | GCGAgtacga |
| 2584 | TCGAgtacga |
| 2585 | GNGAgtacga |
| 2586 | NGGAgtacga |
| 2587 | AGGAgtacga |
| 2588 | CGGAgtacga |
| 2589 | GGGAgtacga |
| 2590 | TGGAgtacga |
| 2591 | TNGAgtacga |
| 2592 | NTGAgtacga |
| 2593 | ATGAgtacga |
| 2594 | CTGAgtacga |
| 2595 | GTGAgtacga |
| 2596 | TTGAgtacga |
| 2597 | ANGAgtagga |

TABLE 14-continued

Intronic REMS DNA sequence (wherein r is adenine or guanine, and n or N is any nucleotide)

| SEQ ID NO. | Sequence |
|---|---|
| 2598 | NAGAgtagga |
| 2599 | AAGAgtagga |
| 2600 | CAGAgtagga |
| 2601 | GAGAgtagga |
| 2602 | TAGAgtagga |
| 2603 | CNGAgtagga |
| 2604 | NCGAgtagga |
| 2605 | ACGAgtagga |
| 2606 | CCGAgtagga |
| 2607 | GCGAgtagga |
| 2608 | TCGAgtagga |
| 2609 | GNGAgtagga |
| 2610 | NGGAgtagga |
| 2611 | AGGAgtagga |
| 2612 | CGGAgtagga |
| 2613 | GGGAgtagga |
| 2614 | TGGAgtagga |
| 2615 | TNGAgtagga |
| 2616 | NTGAgtagga |
| 2617 | ATGAgtagga |
| 2618 | CTGAgtagga |
| 2619 | GTGAgtagga |
| 2620 | TTGAgtagga |
| 2621 | ANGAgtatga |
| 2622 | NAGAgtatga |
| 2623 | AAGAgtatga |
| 2624 | CAGAgtatga |
| 2625 | GAGAgtatga |
| 2626 | TAGAgtatga |
| 2627 | CNGAgtatga |
| 2628 | NCGAgtatga |
| 2629 | ACGAgtatga |
| 2630 | CCGAgtatga |
| 2631 | GCGAgtatga |
| 2632 | TCGAgtatga |
| 2633 | GNGAgtatga |
| 2634 | NGGAgtatga |
| 2635 | AGGAgtatga |
| 2636 | CGGAgtatga |
| 2637 | GGGAgtatga |
| 2638 | TGGAgtatga |
| 2639 | TNGAgtatga |
| 2640 | NTGAgtatga |
| 2641 | ATGAgtatga |
| 2642 | CTGAgtatga |
| 2643 | GTGAgtatga |
| 2644 | TTGAgtatga |
| 2645 | ANGAgtaagc |
| 2646 | NAGAgtaagc |
| 2647 | AAGAgtaagc |
| 2648 | CAGAgtaagc |
| 2649 | GAGAgtaagc |
| 2650 | TAGAgtaagc |
| 2651 | CNGAgtaagc |
| 2652 | NCGAgtaagc |
| 2653 | ACGAgtaagc |
| 2654 | CCGAgtaagc |
| 2655 | GCGAgtaagc |
| 2656 | TCGAgtaagc |
| 2657 | GNGAgtaagc |
| 2658 | NGGAgtaagc |
| 2659 | AGGAgtaagc |
| 2660 | CGGAgtaagc |
| 2661 | GGGAgtaagc |
| 2662 | TGGAgtaagc |
| 2663 | TNGAgtaagc |
| 2664 | NTGAgtaagc |
| 2665 | ATGAgtaagc |
| 2666 | CTGAgtaagc |
| 2667 | GTGAgtaagc |
| 2668 | TTGAgtaagc |
| 2669 | ANGAgtacgc |
| 2670 | NAGAgtacgc |
| 2671 | AAGAgtacgc |

TABLE 14-continued

Intronic REMS DNA sequence (wherein r is adenine or guanine, and n or N is any nucleotide)

| SEQ ID NO. | Sequence |
|---|---|
| 2672 | CAGAgtacgc |
| 2673 | GAGAgtacgc |
| 2674 | TAGAgtacgc |
| 2675 | CNGAgtacgc |
| 2676 | NCGAgtacgc |
| 2677 | ACGAgtacgc |
| 2678 | CCGAgtacgc |
| 2679 | GCGAgtacgc |
| 2680 | TCGAgtacgc |
| 2681 | GNGAgtacgc |
| 2682 | NGGAgtacgc |
| 2683 | AGGAgtacgc |
| 2684 | CGGAgtacgc |
| 2685 | GGGAgtacgc |
| 2686 | TGGAgtacgc |
| 2687 | TNGAgtacgc |
| 2688 | NTGAgtacgc |
| 2689 | ATGAgtacgc |
| 2690 | CTGAgtacgc |
| 2691 | GTGAgtacgc |
| 2692 | TTGAgtacgc |
| 2693 | ANGAgtaggc |
| 2694 | NAGAgtaggc |
| 2695 | AAGAgtaggc |
| 2696 | CAGAgtaggc |
| 2697 | GAGAgtaggc |
| 2698 | TAGAgtaggc |
| 2699 | CNGAgtaggc |
| 2700 | NCGAgtaggc |
| 2701 | ACGAgtaggc |
| 2702 | CCGAgtaggc |
| 2703 | GCGAgtaggc |
| 2704 | TCGAgtaggc |
| 2705 | GNGAgtaggc |
| 2706 | NGGAgtaggc |
| 2707 | AGGAgtaggc |
| 2708 | CGGAgtaggc |
| 2709 | GGGAgtaggc |
| 2710 | TGGAgtaggc |
| 2711 | TNGAgtaggc |
| 2712 | NTGAgtaggc |
| 2713 | ATGAgtaggc |
| 2714 | CTGAgtaggc |
| 2715 | GTGAgtaggc |
| 2716 | TTGAgtaggc |
| 2717 | ANGAgtatgc |
| 2718 | NAGAgtatgc |
| 2719 | AAGAgtatgc |
| 2720 | CAGAgtatgc |
| 2721 | GAGAgtatgc |
| 2722 | TAGAgtatgc |
| 2723 | CNGAgtatgc |
| 2724 | NCGAgtatgc |
| 2725 | ACGAgtatgc |
| 2726 | CCGAgtatgc |
| 2727 | GCGAgtatgc |
| 2728 | TCGAgtatgc |
| 2729 | GNGAgtatgc |
| 2730 | NGGAgtatgc |
| 2731 | AGGAgtatgc |
| 2732 | CGGAgtatgc |
| 2733 | GGGAgtatgc |
| 2734 | TGGAgtatgc |
| 2735 | TNGAgtatgc |
| 2736 | NTGAgtatgc |
| 2737 | ATGAgtatgc |
| 2738 | CTGAgtatgc |
| 2739 | GTGAgtatgc |
| 2740 | TTGAgtatgc |
| 2741 | ANGAgtaagg |
| 2742 | NAGAgtaagg |
| 2743 | AAGAgtaagg |
| 2744 | CAGAgtaagg |
| 2745 | GAGAgtaagg |

TABLE 14-continued

Intronic REMS DNA sequence (wherein r is adenine or guanine, and n or N is any nucleotide)

| SEQ ID NO. | Sequence |
|---|---|
| 2746 | TAGAgtaagg |
| 2747 | CNGAgtaagg |
| 2748 | NCGAgtaagg |
| 2749 | ACGAgtaagg |
| 2750 | CCGAgtaagg |
| 2751 | GCGAgtaagg |
| 2752 | TCGAgtaagg |
| 2753 | GNGAgtaagg |
| 2754 | NGGAgtaagg |
| 2755 | AGGAgtaagg |
| 2756 | CGGAgtaagg |
| 2757 | GGGAgtaagg |
| 2758 | TGGAgtaagg |
| 2759 | TNGAgtaagg |
| 2760 | NTGAgtaagg |
| 2761 | ATGAgtaagg |
| 2762 | CTGAgtaagg |
| 2763 | GTGAgtaagg |
| 2764 | TTGAgtaagg |
| 2765 | ANGAgtacgg |
| 2766 | NAGAgtacgg |
| 2767 | AAGAgtacgg |
| 2768 | CAGAgtacgg |
| 2769 | GAGAgtacgg |
| 2770 | TAGAgtacgg |
| 2771 | CNGAgtacgg |
| 2772 | NCGAgtacgg |
| 2773 | ACGAgtacgg |
| 2774 | CCGAgtacgg |
| 2775 | GCGAgtacgg |
| 2776 | TCGAgtacgg |
| 2777 | GNGAgtacgg |
| 2778 | NGGAgtacgg |
| 2779 | AGGAgtacgg |
| 2780 | CGGAgtacgg |
| 2781 | GGGAgtacgg |
| 2782 | TGGAgtacgg |
| 2783 | TNGAgtacgg |
| 2784 | NTGAgtacgg |
| 2785 | ATGAgtacgg |
| 2786 | CTGAgtacgg |
| 2787 | GTGAgtacgg |
| 2788 | TTGAgtacgg |
| 2789 | ANGAgtaggg |
| 2790 | NAGAgtaggg |
| 2791 | AAGAgtaggg |
| 2792 | CAGAgtaggg |
| 2793 | GAGAgtaggg |
| 2794 | TAGAgtaggg |
| 2795 | CNGAgtaggg |
| 2796 | NCGAgtaggg |
| 2797 | ACGAgtaggg |
| 2798 | CCGAgtaggg |
| 2799 | GCGAgtaggg |
| 2800 | TCGAgtaggg |
| 2801 | GNGAgtaggg |
| 2802 | NGGAgtaggg |
| 2803 | AGGAgtaggg |
| 2804 | CGGAgtaggg |
| 2805 | GGGAgtaggg |
| 2806 | TGGAgtaggg |
| 2807 | TNGAgtaggg |
| 2808 | NTGAgtaggg |
| 2809 | ATGAgtaggg |
| 2810 | CTGAgtaggg |
| 2811 | GTGAgtaggg |
| 2812 | TTGAgtaggg |
| 2813 | ANGAgtatgg |
| 2814 | NAGAgtatgg |
| 2815 | AAGAgtatgg |
| 2816 | CAGAgtatgg |
| 2817 | GAGAgtatgg |
| 2818 | TAGAgtatgg |
| 2819 | CNGAgtatgg |

TABLE 14-continued

Intronic REMS DNA sequence (wherein r is adenine or guanine, and n or N is any nucleotide)

| SEQ ID NO. | Sequence |
|---|---|
| 2820 | NCGAgtatgg |
| 2821 | ACGAgtatgg |
| 2822 | CCGAgtatgg |
| 2823 | GCGAgtatgg |
| 2824 | TCGAgtatgg |
| 2825 | GNGAgtatgg |
| 2826 | NGGAgtatgg |
| 2827 | AGGAgtatgg |
| 2828 | CGGAgtatgg |
| 2829 | GGGAgtatgg |
| 2830 | TGGAgtatgg |
| 2831 | TNGAgtatgg |
| 2832 | NTGAgtatgg |
| 2833 | ATGAgtatgg |
| 2834 | CTGAgtatgg |
| 2835 | GTGAgtatgg |
| 2836 | TTGAgtatgg |
| 2837 | ANGAgtaagt |
| 2838 | NAGAgtaagt |
| 2839 | AAGAgtaagt |
| 2840 | CAGAgtaagt |
| 2841 | GAGAgtaagt |
| 2842 | TAGAgtaagt |
| 2843 | CNGAgtaagt |
| 2844 | NCGAgtaagt |
| 2845 | ACGAgtaagt |
| 2846 | CCGAgtaagt |
| 2847 | GCGAgtaagt |
| 2848 | TCGAgtaagt |
| 2849 | GNGAgtaagt |
| 2850 | NGGAgtaagt |
| 2851 | AGGAgtaagt |
| 2852 | CGGAgtaagt |
| 2853 | GGGAgtaagt |
| 2854 | TGGAgtaagt |
| 2855 | TNGAgtaagt |
| 2856 | NTGAgtaagt |
| 2857 | ATGAgtaagt |
| 2858 | CTGAgtaagt |
| 2859 | GTGAgtaagt |
| 2860 | TTGAgtaagt |
| 2861 | ANGAgtacgt |
| 2862 | NAGAgtacgt |
| 2863 | AAGAgtacgt |
| 2864 | CAGAgtacgt |
| 2865 | GAGAgtacgt |
| 2866 | TAGAgtacgt |
| 2867 | CNGAgtacgt |
| 2868 | NCGAgtacgt |
| 2869 | ACGAgtacgt |
| 2870 | CCGAgtacgt |
| 2871 | GCGAgtacgt |
| 2872 | TCGAgtacgt |
| 2873 | GNGAgtacgt |
| 2874 | NGGAgtacgt |
| 2875 | AGGAgtacgt |
| 2876 | CGGAgtacgt |
| 2877 | GGGAgtacgt |
| 2878 | TGGAgtacgt |
| 2879 | TNGAgtacgt |
| 2880 | NTGAgtacgt |
| 2881 | ATGAgtacgt |
| 2882 | CTGAgtacgt |
| 2883 | GTGAgtacgt |
| 2884 | TTGAgtacgt |
| 2885 | ANGAgtaggt |
| 2886 | NAGAgtaggt |
| 2887 | AAGAgtaggt |
| 2888 | CAGAgtaggt |
| 2889 | GAGAgtaggt |
| 2890 | TAGAgtaggt |
| 2891 | CNGAgtaggt |
| 2892 | NCGAgtaggt |
| 2893 | ACGAgtaggt |

TABLE 14-continued

Intronic REMS DNA sequence (wherein r is adenine or guanine, and n or N is any nucleotide)

| SEQ ID NO. | Sequence |
|---|---|
| 2894 | CCGAgtaggt |
| 2895 | GCGAgtaggt |
| 2896 | TCGAgtaggt |
| 2897 | GNGAgtaggt |
| 2898 | NGGAgtaggt |
| 2899 | AGGAgtaggt |
| 2900 | CGGAgtaggt |
| 2901 | GGGAgtaggt |
| 2902 | TGGAgtaggt |
| 2903 | TNGAgtaggt |
| 2904 | NTGAgtaggt |
| 2905 | ATGAgtaggt |
| 2906 | CTGAgtaggt |
| 2907 | GTGAgtaggt |
| 2908 | TTGAgtaggt |
| 2909 | ANGAgtatgt |
| 2910 | NAGAgtatgt |
| 2911 | AAGAgtatgt |
| 2912 | CAGAgtatgt |
| 2913 | GAGAgtatgt |
| 2914 | TAGAgtatgt |
| 2915 | CNGAgtatgt |
| 2916 | NCGAgtatgt |
| 2917 | ACGAgtatgt |
| 2918 | CCGAgtatgt |
| 2919 | GCGAgtatgt |
| 2920 | TCGAgtatgt |
| 2921 | GNGAgtatgt |
| 2922 | NGGAgtatgt |
| 2923 | AGGAgtatgt |
| 2924 | CGGAgtatgt |
| 2925 | GGGAgtatgt |
| 2926 | TGGAgtatgt |
| 2927 | TNGAgtatgt |
| 2928 | NTGAgtatgt |
| 2929 | ATGAgtatgt |
| 2930 | CTGAgtatgt |
| 2931 | GTGAgtatgt |
| 2932 | TTGAgtatgt |
| 2933 | ANGAgtanga |
| 2934 | NAGAgtanga |
| 2935 | AAGAgtanga |
| 2936 | CAGAgtanga |
| 2937 | GAGAgtanga |
| 2938 | TAGAgtanga |
| 2939 | CNGAgtanga |
| 2940 | NCGAgtanga |
| 2941 | ACGAgtanga |
| 2942 | CCGAgtanga |
| 2943 | GCGAgtanga |
| 2944 | TCGAgtanga |
| 2945 | GNGAgtanga |
| 2946 | NGGAgtanga |
| 2947 | AGGAgtanga |
| 2948 | CGGAgtanga |
| 2949 | GGGAgtanga |
| 2950 | TGGAgtanga |
| 2951 | TNGAgtanga |
| 2952 | NTGAgtanga |
| 2953 | ATGAgtanga |
| 2954 | CTGAgtanga |
| 2955 | GTGAgtanga |
| 2956 | TTGAgtanga |
| 2957 | ANGAgtangc |
| 2958 | NAGAgtangc |
| 2959 | AAGAgtangc |
| 2960 | CAGAgtangc |
| 2961 | GAGAgtangc |
| 2962 | TAGAgtangc |
| 2963 | CNGAgtangc |
| 2964 | NCGAgtangc |
| 2965 | ACGAgtangc |
| 2966 | CCGAgtangc |
| 2967 | GCGAgtangc |

TABLE 14-continued

Intronic REMS DNA sequence (wherein r is adenine or guanine, and n or N is any nucleotide)

| SEQ ID NO. | Sequence |
|---|---|
| 2968 | TCGAgtangc |
| 2969 | GNGAgtangc |
| 2970 | NGGAgtangc |
| 2971 | AGGAgtangc |
| 2972 | CGGAgtangc |
| 2973 | GGGAgtangc |
| 2974 | TGGAgtangc |
| 2975 | TNGAgtangc |
| 2976 | NTGAgtangc |
| 2977 | ATGAgtangc |
| 2978 | CTGAgtangc |
| 2979 | GTGAgtangc |
| 2980 | TTGAgtangc |
| 2981 | ANGAgtangg |
| 2982 | NAGAgtangg |
| 2983 | AAGAgtangg |
| 2984 | CAGAgtangg |
| 2985 | GAGAgtangg |
| 2986 | TAGAgtangg |
| 2987 | CNGAgtangg |
| 2988 | NCGAgtangg |
| 2989 | ACGAgtangg |
| 2990 | CCGAgtangg |
| 2991 | GCGAgtangg |
| 2992 | TCGAgtangg |
| 2993 | GNGAgtangg |
| 2994 | NGGAgtangg |
| 2995 | AGGAgtangg |
| 2996 | CGGAgtangg |
| 2997 | GGGAgtangg |
| 2998 | TGGAgtangg |
| 2999 | TNGAgtangg |
| 3000 | NTGAgtangg |
| 3001 | ATGAgtangg |
| 3002 | CTGAgtangg |
| 3003 | GTGAgtangg |
| 3004 | TTGAgtangg |
| 3005 | ANGAgtangt |
| 3006 | NAGAgtangt |
| 3007 | AAGAgtangt |
| 3008 | CAGAgtangt |
| 3009 | GAGAgtangt |
| 3010 | TAGAgtangt |
| 3011 | CNGAgtangt |
| 3012 | NCGAgtangt |
| 3013 | ACGAgtangt |
| 3014 | CCGAgtangt |
| 3015 | GCGAgtangt |
| 3016 | TCGAgtangt |
| 3017 | GNGAgtangt |
| 3018 | NGGAgtangt |
| 3019 | AGGAgtangt |
| 3020 | CGGAgtangt |
| 3021 | GGGAgtangt |
| 3022 | TGGAgtangt |
| 3023 | TNGAgtangt |
| 3024 | NTGAgtangt |
| 3025 | ATGAgtangt |
| 3026 | CTGAgtangt |
| 3027 | GTGAgtangt |
| 3028 | TTGAgtangt |
| 3029 | ANGAgtgngn |
| 3030 | NAGAgtgngn |
| 3031 | AAGAgtgngn |
| 3032 | CAGAgtgngn |
| 3033 | GAGAgtgngn |
| 3034 | TAGAgtgngn |
| 3035 | CNGAgtgngn |
| 3036 | NCGAgtgngn |
| 3037 | ACGAgtgngn |
| 3038 | CCGAgtgngn |
| 3039 | GCGAgtgngn |
| 3040 | TCGAgtgngn |
| 3041 | GNGAgtgngn |

TABLE 14-continued

Intronic REMS DNA sequence (wherein r is adenine or guanine, and n or N is any nucleotide)

| SEQ ID NO. | Sequence |
|---|---|
| 3042 | NGGAgtgngn |
| 3043 | AGGAgtgngn |
| 3044 | CGGAgtgngn |
| 3045 | GGGAgtgngn |
| 3046 | TGGAgtgngn |
| 3047 | TNGAgtgngn |
| 3048 | NTGAgtgngn |
| 3049 | ATGAgtgngn |
| 3050 | CTGAgtgngn |
| 3051 | GTGAgtgngn |
| 3052 | TTGAgtgngn |
| 3053 | ANGAgtgagn |
| 3054 | NAGAgtgagn |
| 3055 | AAGAgtgagn |
| 3056 | CAGAgtgagn |
| 3057 | GAGAgtgagn |
| 3058 | TAGAgtgagn |
| 3059 | CNGAgtgagn |
| 3060 | NCGAgtgagn |
| 3061 | ACGAgtgagn |
| 3062 | CCGAgtgagn |
| 3063 | GCGAgtgagn |
| 3064 | TCGAgtgagn |
| 3065 | GNGAgtgagn |
| 3066 | NGGAgtgagn |
| 3067 | AGGAgtgagn |
| 3068 | CGGAgtgagn |
| 3069 | GGGAgtgagn |
| 3070 | TGGAgtgagn |
| 3071 | TNGAgtgagn |
| 3072 | NTGAgtgagn |
| 3073 | ATGAgtgagn |
| 3074 | CTGAgtgagn |
| 3075 | GTGAgtgagn |
| 3076 | TTGAgtgagn |
| 3077 | ANGAgtgcgn |
| 3078 | NAGAgtgcgn |
| 3079 | AAGAgtgcgn |
| 3080 | CAGAgtgcgn |
| 3081 | GAGAgtgcgn |
| 3082 | TAGAgtgcgn |
| 3083 | CNGAgtgcgn |
| 3084 | NCGAgtgcgn |
| 3085 | ACGAgtgcgn |
| 3086 | CCGAgtgcgn |
| 3087 | GCGAgtgcgn |
| 3088 | TCGAgtgcgn |
| 3089 | GNGAgtgcgn |
| 3090 | NGGAgtgcgn |
| 3091 | AGGAgtgcgn |
| 3092 | CGGAgtgcgn |
| 3093 | GGGAgtgcgn |
| 3094 | TGGAgtgcgn |
| 3095 | TNGAgtgcgn |
| 3096 | NTGAgtgcgn |
| 3097 | ATGAgtgcgn |
| 3098 | CTGAgtgcgn |
| 3099 | GTGAgtgcgn |
| 3100 | TTGAgtgcgn |
| 3101 | ANGAgtgggn |
| 3102 | NAGAgtgggn |
| 3103 | AAGAgtgggn |
| 3104 | CAGAgtgggn |
| 3105 | GAGAgtgggn |
| 3106 | TAGAgtgggn |
| 3107 | CNGAgtgggn |
| 3108 | NCGAgtgggn |
| 3109 | ACGAgtgggn |
| 3110 | CCGAgtgggn |
| 3111 | GCGAgtgggn |
| 3112 | TCGAgtgggn |
| 3113 | GNGAgtgggn |
| 3114 | NGGAgtgggn |
| 3115 | AGGAgtgggn |

TABLE 14-continued

Intronic REMS DNA sequence (wherein r is adenine or guanine, and n or N is any nucleotide)

| SEQ ID NO. | Sequence |
|---|---|
| 3116 | CGGAgtgggn |
| 3117 | GGGAgtgggn |
| 3118 | TGGAgtgggn |
| 3119 | TNGAgtgggn |
| 3120 | NTGAgtgggn |
| 3121 | ATGAgtgggn |
| 3122 | CTGAgtgggn |
| 3123 | GTGAgtgggn |
| 3124 | TTGAgtgggn |
| 3125 | ANGAgtgtgn |
| 3126 | NAGAgtgtgn |
| 3127 | AAGAgtgtgn |
| 3128 | CAGAgtgtgn |
| 3129 | GAGAgtgtgn |
| 3130 | TAGAgtgtgn |
| 3131 | CNGAgtgtgn |
| 3132 | NCGAgtgtgn |
| 3133 | ACGAgtgtgn |
| 3134 | CCGAgtgtgn |
| 3135 | GCGAgtgtgn |
| 3136 | TCGAgtgtgn |
| 3137 | GNGAgtgtgn |
| 3138 | NGGAgtgtgn |
| 3139 | AGGAgtgtgn |
| 3140 | CGGAgtgtgn |
| 3141 | GGGAgtgtgn |
| 3142 | TGGAgtgtgn |
| 3143 | TNGAgtgtgn |
| 3144 | NTGAgtgtgn |
| 3145 | ATGAgtgtgn |
| 3146 | CTGAgtgtgn |
| 3147 | GTGAgtgtgn |
| 3148 | TTGAgtgtgn |
| 3149 | ANGAgtgaga |
| 3150 | NAGAgtgaga |
| 3151 | AAGAgtgaga |
| 3152 | CAGAgtgaga |
| 3153 | GAGAgtgaga |
| 3154 | TAGAgtgaga |
| 3155 | CNGAgtgaga |
| 3156 | NCGAgtgaga |
| 3157 | ACGAgtgaga |
| 3158 | CCGAgtgaga |
| 3159 | GCGAgtgaga |
| 3160 | TCGAgtgaga |
| 3161 | GNGAgtgaga |
| 3162 | NGGAgtgaga |
| 3163 | AGGAgtgaga |
| 3164 | CGGAgtgaga |
| 3165 | GGGAgtgaga |
| 3166 | TGGAgtgaga |
| 3167 | TNGAgtgaga |
| 3168 | NTGAgtgaga |
| 3169 | ATGAgtgaga |
| 3170 | CTGAgtgaga |
| 3171 | GTGAgtgaga |
| 3172 | TTGAgtgaga |
| 3173 | ANGAgtgcga |
| 3174 | NAGAgtgcga |
| 3175 | AAGAgtgcga |
| 3176 | CAGAgtgcga |
| 3177 | GAGAgtgcga |
| 3178 | TAGAgtgcga |
| 3179 | CNGAgtgcga |
| 3180 | NCGAgtgcga |
| 3181 | ACGAgtgcga |
| 3182 | CCGAgtgcga |
| 3183 | GCGAgtgcga |
| 3184 | TCGAgtgcga |
| 3185 | GNGAgtgcga |
| 3186 | NGGAgtgcga |
| 3187 | AGGAgtgcga |
| 3188 | CGGAgtgcga |
| 3189 | GGGAgtgcga |

TABLE 14-continued

Intronic REMS DNA sequence (wherein r is adenine or guanine, and n or N is any nucleotide)

| SEQ ID NO. | Sequence |
|---|---|
| 3190 | TGGAgtgcga |
| 3191 | TNGAgtgcga |
| 3192 | NTGAgtgcga |
| 3193 | ATGAgtgcga |
| 3194 | CTGAgtgcga |
| 3195 | GTGAgtgcga |
| 3196 | TTGAgtgcga |
| 3197 | ANGAgtggga |
| 3198 | NAGAgtggga |
| 3199 | AAGAgtggga |
| 3200 | CAGAgtggga |
| 3201 | GAGAgtggga |
| 3202 | TAGAgtggga |
| 3203 | CNGAgtggga |
| 3204 | NCGAgtggga |
| 3205 | ACGAgtggga |
| 3206 | CCGAgtggga |
| 3207 | GCGAgtggga |
| 3208 | TCGAgtggga |
| 3209 | GNGAgtggga |
| 3210 | NGGAgtggga |
| 3211 | AGGAgtggga |
| 3212 | CGGAgtggga |
| 3213 | GGGAgtggga |
| 3214 | TGGAgtggga |
| 3215 | TNGAgtggga |
| 3216 | NTGAgtggga |
| 3217 | ATGAgtggga |
| 3218 | CTGAgtggga |
| 3219 | GTGAgtggga |
| 3220 | TTGAgtggga |
| 3221 | ANGAgtgtga |
| 3222 | NAGAgtgtga |
| 3223 | AAGAgtgtga |
| 3224 | CAGAgtgtga |
| 3225 | GAGAgtgtga |
| 3226 | TAGAgtgtga |
| 3227 | CNGAgtgtga |
| 3228 | NCGAgtgtga |
| 3229 | ACGAgtgtga |
| 3230 | CCGAgtgtga |
| 3231 | GCGAgtgtga |
| 3232 | TCGAgtgtga |
| 3233 | GNGAgtgtga |
| 3234 | NGGAgtgtga |
| 3235 | AGGAgtgtga |
| 3236 | CGGAgtgtga |
| 3237 | GGGAgtgtga |
| 3238 | TGGAgtgtga |
| 3239 | TNGAgtgtga |
| 3240 | NTGAgtgtga |
| 3241 | ATGAgtgtga |
| 3242 | CTGAgtgtga |
| 3243 | GTGAgtgtga |
| 3244 | TTGAgtgtga |
| 3245 | ANGAgtgagc |
| 3246 | NAGAgtgagc |
| 3247 | AAGAgtgagc |
| 3248 | CAGAgtgagc |
| 3249 | GAGAgtgagc |
| 3250 | TAGAgtgagc |
| 3251 | CNGAgtgagc |
| 3252 | NCGAgtgagc |
| 3253 | ACGAgtgagc |
| 3254 | CCGAgtgagc |
| 3255 | GCGAgtgagc |
| 3256 | TCGAgtgagc |
| 3257 | GNGAgtgagc |
| 3258 | NGGAgtgagc |
| 3259 | AGGAgtgagc |
| 3260 | CGGAgtgagc |
| 3261 | GGGAgtgagc |
| 3262 | TGGAgtgagc |
| 3263 | TNGAgtgagc |

TABLE 14-continued

Intronic REMS DNA sequence (wherein r is adenine or guanine, and n or N is any nucleotide)

| SEQ ID NO. | Sequence |
|---|---|
| 3264 | NTGAgtgagc |
| 3265 | ATGAgtgagc |
| 3266 | CTGAgtgagc |
| 3267 | GTGAgtgagc |
| 3268 | TTGAgtgagc |
| 3269 | ANGAgtgcgc |
| 3270 | NAGAgtgcgc |
| 3271 | AAGAgtgcgc |
| 3272 | CAGAgtgcgc |
| 3273 | GAGAgtgcgc |
| 3274 | TAGAgtgcgc |
| 3275 | CNGAgtgcgc |
| 3276 | NCGAgtgcgc |
| 3277 | ACGAgtgcgc |
| 3278 | CCGAgtgcgc |
| 3279 | GCGAgtgcgc |
| 3280 | TCGAgtgcgc |
| 3281 | GNGAgtgcgc |
| 3282 | NGGAgtgcgc |
| 3283 | AGGAgtgcgc |
| 3284 | CGGAgtgcgc |
| 3285 | GGGAgtgcgc |
| 3286 | TGGAgtgcgc |
| 3287 | TNGAgtgcgc |
| 3288 | NTGAgtgcgc |
| 3289 | ATGAgtgcgc |
| 3290 | CTGAgtgcgc |
| 3291 | GTGAgtgcgc |
| 3292 | TTGAgtgcgc |
| 3293 | ANGAgtgggc |
| 3294 | NAGAgtgggc |
| 3295 | AAGAgtgggc |
| 3296 | CAGAgtgggc |
| 3297 | GAGAgtgggc |
| 3298 | TAGAgtgggc |
| 3299 | CNGAgtgggc |
| 3300 | NCGAgtgggc |
| 3301 | ACGAgtgggc |
| 3302 | CCGAgtgggc |
| 3303 | GCGAgtgggc |
| 3304 | TCGAgtgggc |
| 3305 | GNGAgtgggc |
| 3306 | NGGAgtgggc |
| 3307 | AGGAgtgggc |
| 3308 | CGGAgtgggc |
| 3309 | GGGAgtgggc |
| 3310 | TGGAgtgggc |
| 3311 | TNGAgtgggc |
| 3312 | NTGAgtgggc |
| 3313 | ATGAgtgggc |
| 3314 | CTGAgtgggc |
| 3315 | GTGAgtgggc |
| 3316 | TTGAgtgggc |
| 3317 | ANGAgtgtgc |
| 3318 | NAGAgtgtgc |
| 3319 | AAGAgtgtgc |
| 3320 | CAGAgtgtgc |
| 3321 | GAGAgtgtgc |
| 3322 | TAGAgtgtgc |
| 3323 | CNGAgtgtgc |
| 3324 | NCGAgtgtgc |
| 3325 | ACGAgtgtgc |
| 3326 | CCGAgtgtgc |
| 3327 | GCGAgtgtgc |
| 3328 | TCGAgtgtgc |
| 3329 | GNGAgtgtgc |
| 3330 | NGGAgtgtgc |
| 3331 | AGGAgtgtgc |
| 3332 | CGGAgtgtgc |
| 3333 | GGGAgtgtgc |
| 3334 | TGGAgtgtgc |
| 3335 | TNGAgtgtgc |
| 3336 | NTGAgtgtgc |
| 3337 | ATGAgtgtgc |

TABLE 14-continued

Intronic REMS DNA sequence (wherein r is adenine or guanine, and n or N is any nucleotide)

| SEQ ID NO. | Sequence |
|---|---|
| 3338 | CTGAgtgtgc |
| 3339 | GTGAgtgtgc |
| 3340 | TTGAgtgtgc |
| 3341 | ANGAgtgagg |
| 3342 | NAGAgtgagg |
| 3343 | AAGAgtgagg |
| 3344 | CAGAgtgagg |
| 3345 | GAGAgtgagg |
| 3346 | TAGAgtgagg |
| 3347 | CNGAgtgagg |
| 3348 | NCGAgtgagg |
| 3349 | ACGAgtgagg |
| 3350 | CCGAgtgagg |
| 3351 | GCGAgtgagg |
| 3352 | TCGAgtgagg |
| 3353 | GNGAgtgagg |
| 3354 | NGGAgtgagg |
| 3355 | AGGAgtgagg |
| 3356 | CGGAgtgagg |
| 3357 | GGGAgtgagg |
| 3358 | TGGAgtgagg |
| 3359 | TNGAgtgagg |
| 3360 | NTGAgtgagg |
| 3361 | ATGAgtgagg |
| 3362 | CTGAgtgagg |
| 3363 | GTGAgtgagg |
| 3364 | TTGAgtgagg |
| 3365 | ANGAgtgcgg |
| 3366 | NAGAgtgcgg |
| 3367 | AAGAgtgcgg |
| 3368 | CAGAgtgcgg |
| 3369 | GAGAgtgcgg |
| 3370 | TAGAgtgcgg |
| 3371 | CNGAgtgcgg |
| 3372 | NCGAgtgcgg |
| 3373 | ACGAgtgcgg |
| 3374 | CCGAgtgcgg |
| 3375 | GCGAgtgcgg |
| 3376 | TCGAgtgcgg |
| 3377 | GNGAgtgcgg |
| 3378 | NGGAgtgcgg |
| 3379 | AGGAgtgcgg |
| 3380 | CGGAgtgcgg |
| 3381 | GGGAgtgcgg |
| 3382 | TGGAgtgcgg |
| 3383 | TNGAgtgcgg |
| 3384 | NTGAgtgcgg |
| 3385 | ATGAgtgcgg |
| 3386 | CTGAgtgcgg |
| 3387 | GTGAgtgcgg |
| 3388 | TTGAgtgcgg |
| 3389 | ANGAgtgggg |
| 3390 | NAGAgtgggg |
| 3391 | AAGAgtgggg |
| 3392 | CAGAgtgggg |
| 3393 | GAGAgtgggg |
| 3394 | TAGAgtgggg |
| 3395 | CNGAgtgggg |
| 3396 | NCGAgtgggg |
| 3397 | ACGAgtgggg |
| 3398 | CCGAgtgggg |
| 3399 | GCGAgtgggg |
| 3400 | TCGAgtgggg |
| 3401 | GNGAgtgggg |
| 3402 | NGGAgtgggg |
| 3403 | AGGAgtgggg |
| 3404 | CGGAgtgggg |
| 3405 | GGGAgtgggg |
| 3406 | TGGAgtgggg |
| 3407 | TNGAgtgggg |
| 3408 | NTGAgtgggg |
| 3409 | ATGAgtgggg |
| 3410 | CTGAgtgggg |
| 3411 | GTGAgtgggg |

TABLE 14-continued

Intronic REMS DNA sequence (wherein r is adenine or guanine, and n or N is any nucleotide)

| SEQ ID NO. | Sequence |
|---|---|
| 3412 | TTGAgtgggg |
| 3413 | ANGAgtgtgg |
| 3414 | NAGAgtgtgg |
| 3415 | AAGAgtgtgg |
| 3416 | CAGAgtgtgg |
| 3417 | GAGAgtgtgg |
| 3418 | TAGAgtgtgg |
| 3419 | CNGAgtgtgg |
| 3420 | NCGAgtgtgg |
| 3421 | ACGAgtgtgg |
| 3422 | CCGAgtgtgg |
| 3423 | GCGAgtgtgg |
| 3424 | TCGAgtgtgg |
| 3425 | GNGAgtgtgg |
| 3426 | NGGAgtgtgg |
| 3427 | AGGAgtgtgg |
| 3428 | CGGAgtgtgg |
| 3429 | GGGAgtgtgg |
| 3430 | TGGAgtgtgg |
| 3431 | TNGAgtgtgg |
| 3432 | NTGAgtgtgg |
| 3433 | ATGAgtgtgg |
| 3434 | CTGAgtgtgg |
| 3435 | GTGAgtgtgg |
| 3436 | TTGAgtgtgg |
| 3437 | ANGAgtgagt |
| 3438 | NAGAgtgagt |
| 3439 | AAGAgtgagt |
| 3440 | CAGAgtgagt |
| 3441 | GAGAgtgagt |
| 3442 | TAGAgtgagt |
| 3443 | CNGAgtgagt |
| 3444 | NCGAgtgagt |
| 3445 | ACGAgtgagt |
| 3446 | CCGAgtgagt |
| 3447 | GCGAgtgagt |
| 3448 | TCGAgtgagt |
| 3449 | GNGAgtgagt |
| 3450 | NGGAgtgagt |
| 3451 | AGGAgtgagt |
| 3452 | CGGAgtgagt |
| 3453 | GGGAgtgagt |
| 3454 | TGGAgtgagt |
| 3455 | TNGAgtgagt |
| 3456 | NTGAgtgagt |
| 3457 | ATGAgtgagt |
| 3458 | CTGAgtgagt |
| 3459 | GTGAgtgagt |
| 3460 | TTGAgtgagt |
| 3461 | ANGAgtgcgt |
| 3462 | NAGAgtgcgt |
| 3463 | AAGAgtgcgt |
| 3464 | CAGAgtgcgt |
| 3465 | GAGAgtgcgt |
| 3466 | TAGAgtgcgt |
| 3467 | CNGAgtgcgt |
| 3468 | NCGAgtgcgt |
| 3469 | ACGAgtgcgt |
| 3470 | CCGAgtgcgt |
| 3471 | GCGAgtgcgt |
| 3472 | TCGAgtgcgt |
| 3473 | GNGAgtgcgt |
| 3474 | NGGAgtgcgt |
| 3475 | AGGAgtgcgt |
| 3476 | CGGAgtgcgt |
| 3477 | GGGAgtgcgt |
| 3478 | TGGAgtgcgt |
| 3479 | TNGAgtgcgt |
| 3480 | NTGAgtgcgt |
| 3481 | ATGAgtgcgt |
| 3482 | CTGAgtgcgt |
| 3483 | GTGAgtgcgt |
| 3484 | TTGAgtgcgt |
| 3485 | ANGAgtgggt |

TABLE 14-continued

Intronic REMS DNA sequence (wherein r is adenine or guanine, and n or N is any nucleotide)

| SEQ ID NO. | Sequence |
|---|---|
| 3486 | NAGAgtgggt |
| 3487 | AAGAgtgggt |
| 3488 | CAGAgtgggt |
| 3489 | GAGAgtgggt |
| 3490 | TAGAgtgggt |
| 3491 | CNGAgtgggt |
| 3492 | NCGAgtgggt |
| 3493 | ACGAgtgggt |
| 3494 | CCGAgtgggt |
| 3495 | GCGAgtgggt |
| 3496 | TCGAgtgggt |
| 3497 | GNGAgtgggt |
| 3498 | NGGAgtgggt |
| 3499 | AGGAgtgggt |
| 3500 | CGGAgtgggt |
| 3501 | GGGAgtgggt |
| 3502 | TGGAgtgggt |
| 3503 | TNGAgtgggt |
| 3504 | NTGAgtgggt |
| 3505 | ATGAgtgggt |
| 3506 | CTGAgtgggt |
| 3507 | GTGAgtgggt |
| 3508 | TTGAgtgggt |
| 3509 | ANGAgtgtgt |
| 3510 | NAGAgtgtgt |
| 3511 | AAGAgtgtgt |
| 3512 | CAGAgtgtgt |
| 3513 | GAGAgtgtgt |
| 3514 | TAGAgtgtgt |
| 3515 | CNGAgtgtgt |
| 3516 | NCGAgtgtgt |
| 3517 | ACGAgtgtgt |
| 3518 | CCGAgtgtgt |
| 3519 | GCGAgtgtgt |
| 3520 | TCGAgtgtgt |
| 3521 | GNGAgtgtgt |
| 3522 | NGGAgtgtgt |
| 3523 | AGGAgtgtgt |
| 3524 | CGGAgtgtgt |
| 3525 | GGGAgtgtgt |
| 3526 | TGGAgtgtgt |
| 3527 | TNGAgtgtgt |
| 3528 | NTGAgtgtgt |
| 3529 | ATGAgtgtgt |
| 3530 | CTGAgtgtgt |
| 3531 | GTGAgtgtgt |
| 3532 | TTGAgtgtgt |
| 3533 | ANGAgtgnga |
| 3534 | NAGAgtgnga |
| 3535 | AAGAgtgnga |
| 3536 | CAGAgtgnga |
| 3537 | GAGAgtgnga |
| 3538 | TAGAgtgnga |
| 3539 | CNGAgtgnga |
| 3540 | NCGAgtgnga |
| 3541 | ACGAgtgnga |
| 3542 | CCGAgtgnga |
| 3543 | GCGAgtgnga |
| 3544 | TCGAgtgnga |
| 3545 | GNGAgtgnga |
| 3546 | NGGAgtgnga |
| 3547 | AGGAgtgnga |
| 3548 | CGGAgtgnga |
| 3549 | GGGAgtgnga |
| 3550 | TGGAgtgnga |
| 3551 | TNGAgtgnga |
| 3552 | NTGAgtgnga |
| 3553 | ATGAgtgnga |
| 3554 | CTGAgtgnga |
| 3555 | GTGAgtgnga |
| 3556 | TTGAgtgnga |
| 3557 | ANGAgtgngc |
| 3558 | NAGAgtgngc |
| 3559 | AAGAgtgngc |

TABLE 14-continued

Intronic REMS DNA sequence (wherein r is adenine or guanine, and n or N is any nucleotide)

| SEQ ID NO. | Sequence |
|---|---|
| 3560 | CAGAgtgngc |
| 3561 | GAGAgtgngc |
| 3562 | TAGAgtgngc |
| 3563 | CNGAgtgngc |
| 3564 | NCGAgtgngc |
| 3565 | ACGAgtgngc |
| 3566 | CCGAgtgngc |
| 3567 | GCGAgtgngc |
| 3568 | TCGAgtgngc |
| 3569 | GNGAgtgngc |
| 3570 | NGGAgtgngc |
| 3571 | AGGAgtgngc |
| 3572 | CGGAgtgngc |
| 3573 | GGGAgtgngc |
| 3574 | TGGAgtgngc |
| 3575 | TNGAgtgngc |
| 3576 | NTGAgtgngc |
| 3577 | ATGAgtgngc |
| 3578 | CTGAgtgngc |
| 3579 | GTGAgtgngc |
| 3580 | TTGAgtgngc |
| 3581 | ANGAgtgngg |
| 3582 | NAGAgtgngg |
| 3583 | AAGAgtgngg |
| 3584 | CAGAgtgngg |
| 3585 | GAGAgtgngg |
| 3586 | TAGAgtgngg |
| 3587 | CNGAgtgngg |
| 3588 | NCGAgtgngg |
| 3589 | ACGAgtgngg |
| 3590 | CCGAgtgngg |
| 3591 | GCGAgtgngg |
| 3592 | TCGAgtgngg |
| 3593 | GNGAgtgngg |
| 3594 | NGGAgtgngg |
| 3595 | AGGAgtgngg |
| 3596 | CGGAgtgngg |
| 3597 | GGGAgtgngg |
| 3598 | TGGAgtgngg |
| 3599 | TNGAgtgngg |
| 3600 | NTGAgtgngg |
| 3601 | ATGAgtgngg |
| 3602 | CTGAgtgngg |
| 3603 | GTGAgtgngg |
| 3604 | TTGAgtgngg |
| 3605 | ANGAgtgngt |
| 3606 | NAGAgtgngt |
| 3607 | AAGAgtgngt |
| 3608 | CAGAgtgngt |
| 3609 | GAGAgtgngt |
| 3610 | TAGAgtgngt |
| 3611 | CNGAgtgngt |
| 3612 | NCGAgtgngt |
| 3613 | ACGAgtgngt |
| 3614 | CCGAgtgngt |
| 3615 | GCGAgtgngt |
| 3616 | TCGAgtgngt |
| 3617 | GNGAgtgngt |
| 3618 | NGGAgtgngt |
| 3619 | AGGAgtgngt |
| 3620 | CGGAgtgngt |
| 3621 | GGGAgtgngt |
| 3622 | TGGAgtgngt |
| 3623 | TNGAgtgngt |
| 3624 | NTGAgtgngt |
| 3625 | ATGAgtgngt |
| 3626 | CTGAgtgngt |
| 3627 | GTGAgtgngt |
| 3628 | TTGAgtgngt |

In certain embodiments, provided herein is a vector comprising the artificial gene construct described herein. In some embodiments, provided herein is a cell comprising an artificial gene construct described herein or a vector comprising an artificial gene construct described herein.

In another aspect, provided herein is a method of modulating the amount and type of a protein produced by a cell containing an artificial gene construct described herein. In one embodiment, provided herein is a method of modulating the amount and type of a protein produced by a cell containing an artificial gene construct described herein, the method comprising contacting the cell with a compound of Formula (I) or a form thereof. In certain embodiments, the artificial gene construct encodes a therapeutic protein. In certain embodiments, the artificial gene construct encodes a non-functional protein. In some embodiments producing a therapeutic protein, the artificial gene construct may also encode a detectable reporter protein. In some embodiments producing a non-functional protein, the artificial gene construct may also encode a detectable reporter protein.

In another aspect, provided herein is a method of modulating the amount of a protein produced by a subject, wherein the subject is or was administered an artificial gene construct described herein. In one embodiment, provided herein is method of regulating the amount of a protein produced by a subject, the method comprising: (a) administering an artificial gene construct or a vector comprising the artificial gene construct described herein to the subject; and (b) administering a compound of Formula (I) or a form thereof to the subject. In another embodiment, provided herein is a method of regulating the amount of a protein produced by a subject, the method comprising administering a compound of Formula (I) or a form thereof to a subject carrying a gene containing a nucleotide sequence encoding an intronic REMS. In another embodiment, provided herein is a method of regulating the amount of a protein produced by a subject, the method comprising administering a compound of Formula (I) to the subject, wherein the subject was previously administered an artificial gene construct described herein. In certain embodiments, the artificial gene construct may encode a therapeutic or a non-functional protein. In some embodiments, the artificial gene construct encodes a detectable reporter protein. In certain embodiments, the subject is a non-human. In specific embodiments, the subject is a human.

In another aspect, provided herein is a method for modulating the amount of an RNA transcript produced from precursor RNA containing an endogenous or non-endogenous intronic recognition element for splicing modifier (REMS), the method comprising contacting the precursor RNA with a compound of Formula (I) or a form thereof, wherein the endogenous or non-endogenous intronic REMS comprises the sequence GAgurngn (SEQ ID NO: 2) wherein r is adenine or guanine and n is any nucleotide, and wherein Formula (I) is

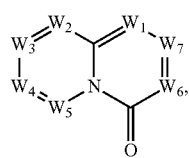

(I)

wherein:
$w_1$ and $w_5$ are independently C—$R_a$ or N;
$w_2$ is C—$R_b$ or N;
$w_3$, $w_4$ and $w_7$ are independently C—$R_1$, C—$R_2$, C—$R_a$ or N;
$w_6$ is C—$R_1$, C—$R_2$, C—$R_c$ or N;
wherein one of $w_3$, $w_4$, $w_6$ and $w_7$ is C—$R_1$ and one other of $w_3$, $w_4$, $w_6$ and $w_7$ is C—$R_2$, provided that,
when $w_3$ is C—$R_1$, then $w_6$ is C—$R_2$ and $w_4$ and $w_7$ are independently C—$R_a$ or N; or,
when $w_3$ is C—$R_2$, then $w_6$ is C—$R_1$ and $w_4$ and $w_7$ are independently C—$R_a$ or N; or,
when $w_4$ is C—$R_1$, then $w_7$ is C—$R_2$ and $w_3$ is C—$R_a$ or N and $w_6$ is C—$R_c$ or N; or,
when $w_4$ is C—$R_2$, then $w_7$ is C—$R_1$ and $w_3$ is C—$R_a$ or N and $w_6$ is C—$R_c$ or N; and,
wherein any one, two or three of $w_1$, $w_2$, $w_3$, $w_4$, $w_5$, $w_6$ and $w_7$ may optionally be N;
$R_1$ is $C_{1-8}$alkyl, amino, $C_{1-8}$alkyl-amino, $(C_{1-8}$alkyl$)_2$-amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl)amino, amino-$C_{1-8}$alkyl, $C_{1-8}$alkyl-amino-$C_{1-8}$alkyl, $(C_{1-8}$alkyl$)_2$-amino-$C_{1-8}$alkyl, $C_{1-8}$alkoxy-$C_{1-8}$alkyl-amino-$C_{1-8}$alkyl, $(C_{1-8}$alkoxy-$C_{1-8}$alkyl$)_2$-amino-$C_{1-8}$alkyl, $(C_{1-8}$alkoxy-$C_{1-8}$alkyl$)(C_{1-8}$alkyl)amino-$C_{1-8}$alkyl, amino-$C_{1-8}$alkyl-amino, (amino-$C_{1-8}$alkyl$)_2$-amino, (amino-$C_{1-8}$alkyl$)(C_{1-8}$alkyl)amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl-amino-$C_{1-8}$alkyl$)(C_{1-8}$alkyl)amino, $(C_{1-8}$alkyl$)_2$-amino-$C_{1-8}$alkyl-amino, $[(C_{1-8}$alkyl$)_2$-amino-$C_{1-8}$alkyl$](C_{1-8}$alkyl)amino, amino-$C_{1-8}$alkoxy, $C_{1-8}$alkyl-amino-$C_{1-8}$alkoxy, $(C_{1-8}$alkyl$)_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, $(C_{1-8}$alkoxy-$C_{1-8}$alkyl$)(C_{1-8}$alkyl)amino-$C_{1-8}$alkoxy, amino-$C_{2-8}$alkenyl, $C_{1-8}$alkyl-amino-$C_{2-8}$alkenyl, $(C_{1-8}$alkyl$)_2$-amino-$C_{2-8}$alkenyl, amino-$C_{2-8}$alkynyl, $C_{1-8}$alkyl-amino-$C_{2-8}$alkynyl, $(C_{1-8}$alkyl$)_2$-amino-$C_{2-8}$alkynyl, halo-$C_{1-8}$alkyl-amino, (halo-$C_{1-8}$alkyl$)_2$-amino, (halo-$C_{1-8}$alkyl$)(C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino, (hydroxy-$C_{1-8}$alkyl$)(C_{1-8}$alkyl)amino, hydroxy-$C_{1-8}$alkyl-amino-$C_{1-8}$alkyl, (hydroxy-$C_{1-8}$alkyl$)_2$-amino-$C_{1-8}$alkyl, (hydroxy-$C_{1-8}$alkyl$)(C_{1-8}$alkyl)amino-$C_{1-8}$alkyl, hydroxy-$C_{1-8}$alkyl-amino-$C_{1-8}$alkoxy, (hydroxy-$C_{1-8}$alkyl$)_2$-amino-$C_{1-8}$alkoxy, (hydroxy-$C_{1-8}$alkyl$)(C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl$)_2$-amino, (hydroxy-$C_{1-8}$alkyl$)_2$-amino-$C_{1-8}$alkyl-amino, (hydroxy-$C_{1-8}$alkyl-amino-$C_{1-8}$alkyl$)(C_{1-8}$alkyl)amino, (hydroxy-$C_{1-8}$alkyl$)(C_{1-8}$alkyl)amino-$C_{1-8}$alkyl-amino, [(hydroxy-$C_{1-8}$alkyl$)_2$-amino-$C_{1-8}$alkyl]$(C_{1-8}$alkyl)amino, [(hydroxy-$C_{1-8}$alkyl$)(C_{1-8}$alkyl)amino-$C_{1-8}$alkyl]$(C_{1-8}$alkyl)amino, heterocyclyl, heterocyclyl-$C_{1-8}$alkyl, heterocyclyl-$C_{1-8}$alkoxy, heterocyclyl-amino, (heterocyclyl)$(C_{1-8}$alkyl)amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl$)(C_{1-8}$alkyl)amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl$)(C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl$)_2$-amino, (aryl-$C_{1-8}$alkyl$)(C_{1-8}$alkyl)amino, aryl-$C_{1-8}$alkyl-amino-$C_{1-8}$alkyl, (aryl-$C_{1-8}$alkyl$)_2$-amino-$C_{1-8}$alkyl, (aryl-$C_{1-8}$alkyl$)(C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl$)(C_{1-8}$alkyl)amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl$)(C_{1-8}$alkyl)amino-$C_{1-8}$alkyl;
wherein, each instance of heterocyclyl, $C_{3-14}$cycloalkyl, aryl and heteroaryl is optionally substituted with one, two or three R<sub>3</sub> substituents and optionally, with one additional R<sub>4</sub> substituent; or, wherein, each instance of heterocyclyl, $C_{3-14}$cycloalkyl, aryl and heteroaryl is optionally substituted with one, two, three or four R<sub>3</sub> substituents;

R<sub>2</sub> is aryl, aryl-amino, aryl-amino-carbonyl, heterocyclyl, heteroaryl or heteroaryl-amino; wherein, each instance of aryl, heterocyclyl and heteroaryl is optionally substituted with one, two or three R<sub>6</sub> substituents and optionally, with one additional R<sub>7</sub> substituent;

R<sub>a</sub> is, in each instance, independently selected from hydrogen, halogen, $C_{1-8}$alkyl or deuterium;

R<sub>b</sub> is hydrogen, halogen, $C_{1-8}$alkyl, $C_{1-8}$alkoxy or deuterium;

R<sub>c</sub> is hydrogen, halogen, $C_{1-8}$alkyl or deuterium;

R<sub>3</sub> is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

R<sub>4</sub> is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three R<sub>5</sub> substituents;

R<sub>5</sub> is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

R<sub>6</sub> is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, R<sub>7</sub> is $C_{3-14}$cycloalkyl, $C_{3-14}$cycloalkyl-oxy, aryl, heterocyclyl or heteroaryl.

In another aspect, provided herein is a method for modulating the amount of an RNA transcript produced from precursor RNA containing an endogenous or non-endogenous intronic recognition element for splicing modifier (REMS), the method comprising contacting the precursor RNA with a compound of Formula (I) or a form thereof, wherein the endogenous or non-endogenous intronic REMS comprises the sequence NNGAgurngn (SEQ ID NO: 1), wherein r is adenine or guanine and n or N is any nucleotide, and wherein Formula (I) is

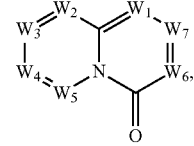

wherein:
w<sub>1</sub> and w<sub>5</sub> are independently C—R<sub>a</sub> or N;
w<sub>2</sub> is C—R<sub>b</sub> or N;
w<sub>3</sub>, w<sub>4</sub> and w<sub>7</sub> are independently C—R<sub>1</sub>, C—R<sub>2</sub>, C—R<sub>a</sub> or N;
w<sub>6</sub> is C—R<sub>1</sub>, C—R<sub>2</sub>, C—R<sub>c</sub> or N;
wherein one of w<sub>3</sub>, w<sub>4</sub>, w<sub>6</sub> and w<sub>7</sub> is C—R<sub>1</sub> and one other of w<sub>3</sub>, w<sub>4</sub>, w<sub>6</sub> and w<sub>7</sub> is C—R<sub>2</sub>, provided that,
when w<sub>3</sub> is C—R<sub>1</sub>, then w<sub>6</sub> is C—R<sub>2</sub> and w<sub>4</sub> and w<sub>7</sub> are independently C—R<sub>a</sub> or N; or,
when w<sub>3</sub> is C—R<sub>2</sub>, then w<sub>6</sub> is C—R<sub>1</sub> and w<sub>4</sub> and w<sub>7</sub> are independently C—R<sub>a</sub> or N; or,
when w<sub>4</sub> is C—R<sub>1</sub>, then w<sub>7</sub> is C—R<sub>2</sub> and w<sub>3</sub> is C—R<sub>a</sub> or N and w<sub>6</sub> is C—R<sub>c</sub> or N; or,
when w<sub>4</sub> is C—R<sub>2</sub>, then w<sub>7</sub> is C—R<sub>1</sub> and w<sub>3</sub> is C—R<sub>a</sub> or N and w<sub>6</sub> is C—R<sub>c</sub> or N; and,
wherein any one, two or three of w<sub>1</sub>, w<sub>2</sub>, w<sub>3</sub>, w<sub>4</sub>, w<sub>5</sub>, w<sub>6</sub> and w<sub>7</sub> may optionally be N;

R<sub>1</sub> is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl- $C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In another aspect, provided herein is a method of regulating the amount and type of a protein produced by a gene comprising a nucleotide sequence encoding an endogenous or non-endogenous intronic REMS in a subject, wherein the nucleotide sequence encoding the endogenous or non-endogenous intronic REMS comprises the sequence GAgtrngn (SEQ ID NO: 4), wherein r is adenine or guanine and n is any nucleotide, the method comprising administering a compound of Formula (I) to the subject, wherein Formula (I) is

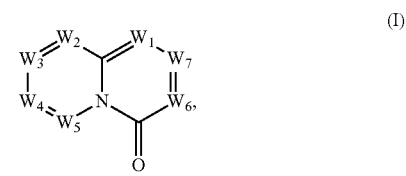

(I)

wherein:

$w_1$ and $w_5$ are independently C—$R_a$ or N;

$w_2$ is C—$R_b$ or N;

$w_3$, $w_4$ and $w_7$ are independently C—$R_1$, C—$R_2$, C—$R_a$ or N;

$w_6$ is C—$R_1$, C—$R_2$, C—$R_c$ or N;

wherein one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N; and, wherein any one, two or three of $w_1$, $w_2$, $w_3$, $w_4$, $w_5$, $w_6$ and $w_7$ may optionally be N;

$R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In another aspect, provided herein is a method of regulating the amount and type of a protein produced by a gene comprising a nucleotide sequence encoding an endogenous or non-endogenous intronic REMS in a subject, wherein the nucleotide sequence encoding the endogenous or non-endogenous intronic REMS comprises the sequence NNGAgtrngn (SEQ ID NO: 3), wherein r is adenine or guanine and n or N is any nucleotide, the method comprising administering a compound of Formula (I) to the subject, wherein Formula (I) is

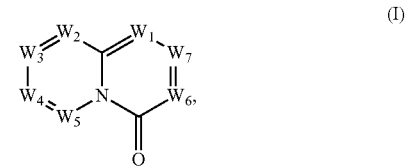

(I)

wherein:
$w_1$ and $w_5$ are independently C—$R_a$ or N;
$w_2$ is C—$R_b$ or N;
$w_3$, $w_4$ and $w_7$ are independently C—$R_1$, C—$R_2$, C—$R_a$ or N;
$w_6$ is C—$R_1$, C—$R_2$, C—$R_c$ or N;
wherein one of $w_3$, $w_4$, $w_6$ and $w_7$ is C—$R_1$ and one other of $w_3$, $w_4$, $w_6$ and $w_7$ is C—$R_2$, provided that,
when $w_3$ is C—$R_1$, then $w_6$ is C—$R_2$ and $w_4$ and $w_7$ are independently C—$R_a$ or N; or,
when $w_3$ is C—$R_2$, then $w_6$ is C—$R_1$ and $w_4$ and $w_7$ are independently C—$R_a$ or N; or,
when $w_4$ is C—$R_1$, then $w_7$ is C—$R_2$ and $w_3$ is C—$R_a$ or N and $w_6$ is C—$R_c$ or N; or,
when $w_4$ is C—$R_2$, then $w_7$ is C—$R_1$ and $w_3$ is C—$R_a$ or N and $w_6$ is C—$R_c$ or N; and,
wherein any one, two or three of $w_1$, $w_2$, $w_3$, $w_4$, $w_5$, $w_6$ and $w_7$ may optionally be N;
$R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, ($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In specific embodiments of the aspects and embodiments described herein, the gene is, or the RNA transcript is transcribed from a gene that is selected from: ABCA1, ABCA10, ABCB7, ABCB8, ABCC1, ABCC3, ABHD10, ABL2, ABLIM3, ACACA, ACADVL, ACAT2, ACTA2, ADAL, ADAM12, ADAM15, ADAM17, ADAM33, ADAMTS1, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP9, AKNA, ALCAM, ALDH4A1, AMPD2, ANK1, ANK2, ANK3, ANKFY1, ANKHD1-EIF4EBP3, ANKRA2, ANKRD17, ANKRD33B, ANKRD36, ANKS6, ANP32A, ANXA11, ANXA6, AP2B1, AP4B1-AS1, APAF1, APIP, APLP2, APP, APPL2, APTX, ARHGAP1, ARHGAP12, ARHGAP22, ARHGEF16, ARID1A, ARID2, ARID5B, ARL9, ARL15, ARMCX3, ARMCX6, ASAP1, ASIC1, ASL, ASNS, ASPH, ATAD2B, ATF7IP, ATG5, ATG9A, ATMIN, ATP2A3, ATP2C1, ATXN1, ATXN3, AURKA, AXIN1, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3-IT1, BIRC3, BIRC6, BNC1, BRD2, BRPF1, BSCL2, BTBD10, BTG2, BTN3A1, BZW1, C1orf86, C10orf54, C11orf30, C11orf70, C11orf73, C11orf94, C12orf4, C12orf56, C14orf132, C17orf76-AS1, C19orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CADM1, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCT6A, CD276, CD46, CDC25B, CDC40, CDC42BPA, CDCA7, CDH11, CDH13, CDK11B, CDK16, CDKAL1, CECR7, CELSR1, CEMIP, CENPI, CEP112, CEP170, CEP192, CEP68, CFH, CFLAR, CHD8, CHEK1, CIITA, CIZ1, CLDN23, CLIC1, CLK4, CLTA, CMAHP, CNGA4, CNOT1, CNRIP1, CNTD1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRYBG3, CRYL1, CSDE1, CSNK1A1, CSNK1E, CSNK1G1, CTDSP2, CTNND1, CUL2, CUL4A, CUX1, CYB5B, CYB5R2, CYBRD1, CYGB, CYP1B1, CYP51A1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND5A, DEPTOR, DFNB59, DGCR2, DGKA, DHCR24, DHCR7, DHFR, DHX9, DIAPH1, DIAPH3, DIRAS3, DIS3L, DKFZp434M1735, DKK3, DLC1, DLG5, DLGAP4, DNAH8, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEF1A1, EFCAB14, EFEMP1, EGR1, EGR3, EHMT2, EIF2B3, EIF4G1, EIF4G2, EIF4G3, ELF2, ELN, ELP4, EMX2OS, ENAH, ENG, ENPP1, ENPP2, ENSA, EP300, EPN1, EPT1, ERC1, ERCC1, ERCC8, ERGIC3, ERLIN2, ERRFI1, ESM1, ETV5, EVC, EVC2, EXO1, EXTL2, EYA3, F2R, FADS1, FADS2, FAF1, FAIM, FAM111A, FAM126A, FAM13A, FAM160A1, FAM162A, FAM174A, FAM198B, FAM20A, FAM219A, FAM219B, FAM3C, FAM46B, FAM65A, FAM65B, FAP, FARP1, FBLN2, FBN2, FBXO9, FBXL6, FBXO10, FBXO18, FBXO31, FBXO34, FBXO9, FCHO1, FDFT1, FDPS, FER, FEZ1, FGD5-AS1, FGFR2, FGFRL1, FGL2, FHOD3, FLII, FLNB, FLT1, FN1, FNBP1, FOCAD, FOS, FOSB, FOSL1, FOXK1, FOXM1, FRAS1, FSCN2, FUS, FYN, GABPB1, GAL3ST4, GALC, GALNT1, GALNT15, GAS7, GATA6, GBA2, GBGT1, GCFC2, GCNT1, GDF6, GGACT, GGCT, GHDC, GIGYF2, GJC1, GLCE, GMIP, GNA13, GNAQ, GNAS, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HOOK3, HMOX1, HNMT, HNRNPR, HNRNPUL1, HP1BP3, HPS1, HRH1, HSD17B12, HSD17B4, HSPA1L, HTATIP2, HTT, IARS, IDH1, IDI1, IFT57, IGDCC4, IGF2BP2, IGF2R, IGFBP3, IL16, IL6ST, INA, INHBA, INPP5K, INSIG1, INTU, IQCE, IQCG, ITGA11, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIF14, KIF2A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LARP7, LATS2, LDLR, LEMD3, LETM2, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LMAN2L, LMO7, LMOD1, LOC400927, LONP1, LOX, LRBA, LRCH4, LRIG1, LRP4, LRP8, LRRC32, LRRC39, LRRC42, LRRC8A, LSAMP, LSS, LTBR, LUC7L2, LUM, LYPD1, LYRM1, LZTS2, MADD, MAFB, MAGED4, MAGED4B, MAMDC2, MAN1A2, MAN2A1, MAN2C1, MAP4K4, MAPK13, MASP1, MB, MB21D2, MBD1, MBOAT7, MC4R, MCM10, MDM2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MOXD1, MPPE1, MPZL1, MRPL3, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR9, MTRR, MUM1, MVD, MVK, MXRA5, MYADM, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NELFA, NEO1, NEURL1B, NF2, NFE2L1, NFX1, NGF, NGFR, NHLH1, NID1, NID2, NIPA1, NKX3-1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PBLD, PCBP2, PCBP4, PCDHGB3, PCGF3, PCM1, PCMTD2, PCNXL2, PCSK9, PDE1C, PDE4A, PDE5A, PDE7A, PDGFD, PDGFRB, PDLIM7, PDS5B, PDXDC1, PEAR1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPHLN1, PPIP5K1, PPIP5K2, PPM1E, PPP1R12A, PPP1R26, PPP3CA, PPP6R1, PPP6R2, PRKACB, PRKCA, PRKDC, PRKG1, PRMT1, PRNP, PRPF31, PRPH2, PRRG4, PRS S23, PRUNE2, PSMA4, PSMC1, PSMD6, PSMD6-AS2, PTGIS, PTK2B, PTPN14, PTX3, PUF60, PUS7, PVR, PXK, PXN, QKI, RAB23, RAB2B, RAB30, RAB34, RAB38, RAB44, RAD1, RAD9B, RAD23B, RAF1, RALB, RAP1A, RAP1GDS1, RAPGEF1, RARG, RARS, RARS2, RASSF8, RBBP8, RBCK1, RBFOX2, RBKS, RBM10, RCC1, RDX, RERE, RFTN1, RFWD2, RFX3-AS1, RGCC, RGS10, RGS3, RIF1, RNF14, RNF19A, RNF38, RNFT1, ROR1, ROR2, RPA1, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SGK3, SGOL2, SH3RF1, SH3YL1, SHROOM3, SIGLEC10, SKA2, SKIL, SLC12A2, SLC24A3, SLC25A17, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMN2, SMPD4, SMTN, SMYD3, SMYD5, SNAP23, SNED1, SNHG16, SNX7, SNX14, SOCS2, SON, SORBS2, SORCS2, SOS2, SOX7, SPATA18, SPATA20, SPATA5, SPATS2, SPDYA, SPEF2, SPG20, SPIDR, SPRED2, SPRYD7, SQLE, SQRDL, SQSTM1, SRCAP, SREBF1, SREK1, SRGAP1, SRRM1, SRSF3, STAC2, STARD4, STAT1, STAT3, STAT4, STAU1, STC2, STEAP2, STK32B, STRIP1, STRN3, STRN4, STS, STX16, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBL2, TCF12, TCF4, TCF7L2, TENC1, TENM2, TEP1, TET3, TEX21P, TFCP2, TGFA, TGFB2, TGFB3, TGFBI, TGFBR1, TGFBRAP1, TGM2, THADA, THAP4, THBS2, THRB, TIAM1, TIMP2, TJP2, TLE3, TLK1, TMC3, TMEM102, TMEM119, TMEM134, TMEM154, TMEM189-UBE2V1, TMEM214, TMEM256-PLSCR3, TMEM47, TMEM50B, TMEM63A, TNC, TNFAIP3, TNFAIP8L3, TNFRSF12A, TNFRSF14, TNIP1, TNKS1BP1, TNPO3, TNRC18P1, TNRC6A, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNRD1, TYW5, U2SURP, UBAP2L, UBE2G2, UBE2V1, UBQLN4, UCHL5, UHMK1, UHRF1BP1L, UNC5B, URGCP, USP19, USP7, USP27X, UVRAG, VANGL1, VARS2, VAV2, VCL, VIM-AS1, VIPAS39, VPS13A, VPS29, VPS41, VPS51, VSTM2L, VWA8, VWF, WDR19, WDR27, WDR37, WDR48, WDR91, WIPF1, WISP1, WNK1, WNT5B, WNT10B, WSB1, WWTR1, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMYM2, ZNF12, ZNF138, ZNF148, ZNF212, ZNF219, ZNF227, ZNF232, ZNF24, ZNF268, ZNF28, ZNF281, ZNF335, ZNF350, ZNF37A, ZNF37BP, ZNF395, ZNF431, ZNF583, ZNF621, ZNF652, ZNF655, ZNF660, ZNF674, ZNF680, ZNF74, ZNF764, ZNF778, ZNF780A, ZNF79, ZNF827, ZNF837, ZNF839 or ZNF91.

In another specific embodiment of the aspects and embodiments described herein, the gene is, or the RNA transcript is transcribed from a gene that is selected from: ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX20S, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837.

In another specific embodiment of the aspects and embodiments described herein, the gene is, or the RNA transcript is transcribed from a gene that is not described in International Publication No. WO 2015/105657. In another specific embodiment of the aspects and embodiments described herein, the gene is, or the RNA transcript is transcribed from a gene that is not described in International Publication No. WO 2016/196386. In another specific embodiment of the aspects and embodiments described herein, the gene is, or the RNA transcript is transcribed from a gene that is not described in International Publication No. WO 2015/105657 and not described in International Publication No. WO 2016/196386.

In another specific embodiment of the aspects and embodiments described herein, the gene is, or the RNA transcript is transcribed from a gene that is selected from: ABCA1, ABCB7, ABCC1, ABHD10, ABL2, ABLIM3, ACACA, ACADVL, ACAT2, ADAM12, ADAM15, ADAM17, ADAM33, AFF2, AGK, AGPAT3, AGPS, AHCYL2, AHDC1, AHRR, AJUBA, AK021888, AK310472, AKAP1, AKAP9, AKNA, ALCAM, ALDH4A1, AMPD2, ANK2, ANKFY1, ANKHD1-EIF4EBP3, ANKRD17, ANKS6, ANP32A, ANXA11, ANXA6, AP2B1, APAF1, APLP2, APP, APPL2, APTX, ARHGAP22, ARID1A, ARID2, ARMCX3, ASAP1, ASL, ASNS, ASPH, ATAD2B, ATF7IP, ATG9A, ATMIN, ATP2C1, ATXN3, AURKA, AXIN1, B4GALT2, BACE1, BAG2, BASP1, BC033281, BCAR3, BEND6, BICD1, BIN1, BNC1, BRD2, BRPF1, BSCL2, BTBD10, BZW1, C11orf30, C11orf73, C17orf76-AS1, C4orf27, C5orf24, C6orf48, C9orf69, CAB39, CALU, CAMKK1, CAPNS1, CASC3, CASP8AP2, CAV1, CCAR1, CCDC77, CCDC88A, CCDC92, CCT6A, CD276, CD46, CDC25B, CDC40, CDC42BPA, CDCA7, CDH11, CDH13, CDK11B, CDK16, CDKAL1, CEP68, CFLAR, CHD8, CIZ1, CLIC1, CLK4, CNOT1, COG1, COL12A1, COL1A1, COL6A1, COPS7B, CPEB2, CREB5, CRLS1, CRTAP, CSDE1, CSNK1A1, CTDSP2, CTNND1, CUL2, CUL4A, CUX1, CYB5B, CYBRD1, CYP51A1, DAB2, DACT1, DARS, DAXX, DCAF10, DCAF11, DCBLD2, DCUN1D4, DDAH1, DDAH2, DDHD2, DDR1, DDX39B, DDX42, DENND1A, DENND1B, DENND5A, DGCR2, DGKA, DHCR24, DHCR7, DHFR, DHX9, DIAPH1, DIAPH3, DIS3L, DKFZp434M1735, DKK3, DLC1, DNM2, DOCK1, DPP8, DSEL, DST, DSTN, EBF1, EEA1, EEF1A1, EFCAB14, EGR1, EHMT2, EIF2B3, EIF4G1, EIF4G2, EIF4G3, ELF2, ENG, ENPP2, ENSA, EPN1, EPT1, ERC1, ERGIC3, ETV5, EXO1, EXTL2, EYA3, FADS1, FADS2, FAF1, FAM111A, FAM198B, FAM219A, FAM219B, FAM3C, FAM65A, FBXO10, FBXO18, FBXO31, FBXO34, FBXO9, FDFT1, FDPS, FER, FEZ1, FGD5-AS1, FGFRL1, FHOD3, FLII, FLNB, FN1, FNBP1, FOCAD, FOS, FOSB, FOSL1, FOXK1, FOXM1, FUS, FYN, GABPB1, GALC, GALNT1, GAS7, GBA2, GCFC2, GGCT, GHDC, GIGYF2, GJC1, GMIP, GNA13, GNAS, GNL3L, GOLGA2, GOLGA4, GOLGB1, GORASP1, GPR1, GPR89A, GPSM2, GREM1, GRK6, GSE1, GTF2H2B, HAS2, HAT1, HAUS3, HAUS6, HDAC7, HEG1, HLA-A, HLA-E, HLTF, HMGA1, HMGB1, HMGCR, HMGCS1, HMOX1, HNRNPR, HNRNPUL1, HP1BP3, HRH1, HSD17B12, HSD17B4, HTT, IARS, IDH1, IDI1, IGF2BP2, IL6ST, INHBA, INSIG1, IQCE, ITGAV, ITGB5, ITM2C, ITSN1, KANSL3, KCNK2, KIAA1033, KIAA1143, KIAA1199, KIAA1522, KIAA1524, KIAA1549, KIAA1715, KIF14, KIF2A, KIF3A, KLC1, KLC2, KLF6, KLHL7, KRT18, KRT19, KRT34, KRTAP2-3, LAMA2, LAMB1, LARP4, LARP7, LATS2, LDLR, LEMD3, LGALS8, LIMS1, LINC00341, LINC00657, LMAN2L, LMO7, LONP1, LOX, LRCH4, LRIG1, LRP8, LRRC8A, LSS, LTBR, LUC7L2, LZTS2, MADD, MAGED4, MAGED4B, MAN1A2, MAP4K4, MBD1, MBOAT7, MDM2, MED1, MEDAG, MEF2D, MEIS2, MEMO1, MEPCE, MFGE8, MICAL2, MINPP1, MKL1, MKLN1, MKNK2, MLLT4, ML ST8, MMAB, MMS19, MMS22L, MPPE1, MPZL1, MRPL3, MSANTD3, MSC, MSH2, MSH6, MSL3, MSMO1, MSRB3, MTAP, MTERFD1, MTHFD1L, MTMR9, MTRR, MUM1, MVD, MVK, MYADM, MYLK, MYO1D, MYO9B, MYOF, NAA35, NADK, NASP, NAV1, NAV2, NCOA1, NCOA3, NCOA4, NCSTN, NELFA, NEO1, NEURL1B, NF2, NFE2L1, NFX1, NID1, NID2, NIPA1, NKX3-1, NOL10, NOMO3, NPEPPS, NRD1, NREP, NRG1, NSUN4, NT5C2, NT5E, NTNG1, NUDT4, NUP153, NUP35, NUP50, NUPL1, NUSAP1, ODF2, OS9, OSBPL6, OSMR, P4HA1, P4HB, PABPC1, PAK4, PAPD4, PARD3, PARN, PARP14, PARP4, PARVB, PCBP2, PCBP4, PCDHGB3, PCGF3, PCM1, PCMTD2, PCNXL2, PCSK9, PDE4A, PDE7A, PDLIM7, PDXDC1, PEPD, PEX5, PFKP, PHF19, PHF8, PHRF1, PHTF2, PI4K2A, PIEZO1, PIGU, PIK3C2B, PITPNA, PITPNB, PITPNM1, PLAU, PLEC, PLEKHB2, PLSCR3, PLXNB2, PLXNC1, PMS1, POLE3, POLR3D, POSTN, POU2F1, PPAPDC1A, PPARA, PPHLN1, PPIP5K1, PPP1R12A, PPP6R1, PPP6R2, PRKACB, PRKDC, PRMT1, PRNP, PRSS23, PSMA4, PSMC1, PSMD6, PTK2B, PTPN14, PUF60, PUS7, PVR, PXN, QKI, RAB23, RAB2B, RAB34, RAD1, RAD23B, RALB, RAP1A, RAP1GDS1, RARG, RASSF8, RBCK1, RBFOX2, RBM10, RCC1, RFTN1, RFWD2, RGS10, RGS3, RIF1, RNF14, RNF19A, RNF38, RNFT1, RPL10, RPS6KC1, RRBP1, RWDD4, SAMD9, SAMD9L, SAR1A, SART3, SCAF4, SCAF8, SCD, SCLT1, SCO1, SDCBP, SEC14L1, SEC22A, SEC24B, SEC61A1, SEPT9, SERPINE2, SF1, SGOL2, SH3RF1, SKIL, SLC25A17, SLC39A3, SLC41A1, SLC4A4, SLC7A6, SLC7A8, SMARCA4, SMARCC2, SMC4, SMC6, SMCHD1, SMG1, SMN2, SMPD4, SMYD3, SMYD5, SNAP23, SNHG16, SNX14, SOCS2, SON, SOS2, SPATA20, SPATS2, SPG20, SPRED2, SQLE, SQRDL, SQSTM1, SRCAP, SREBF1, SREK1, SRSF3, STARD4, STAT1, STAT3, STAU1, STC2, STEAP2, STRIP1, STRN3, STX16, SUPT20H, SYNE1, SYNE2, SYT15, SYTL2, TACC1, TAF2, TANC2, TARBP1, TARS, TBC1D15, TBL2, TCF7L2, TENC1, TENM2, TEP1, TET3, TFCP2, TGFBI, TGFBR1, TGFBRAP1, THADA, THAP4, THRB, TIMP2, TJP2, TLE3, TLK1, TMEM154, TMEM47, TMEM63A, TNC, TNFAIP3, TNFRSF12A, TNIP1, TNKS1BP1, TNPO3, TNS1, TNS3, TOE1, TOMM40, TOMM5, TOPORS, TP53INP1, TRAF3, TRAK1, TRAPPC12, TRIB1, TRIM2, TRIM23, TRIM26, TRIM28, TRIM65, TRMT1L, TRPS1, TSC2, TSHZ1, TSPAN2, TTC7A, TUBB2C, TUBB3, TXNL1, TXNRD1, U2SURP, UBAP2L, UBE2G2, UBE2V1, UBQLN4, UCHL5, UHMK1, UHRF1BP1L, UNC5B, USP19, USP7, VANGL1, VARS2, VCL, VIPAS39, VPS13A, VPS29, VPS51, VWA8, WDR19, WDR37, WDR48, WIPF1, WNT5B, WSB1, WWTR1, XIAP, XRN2, YAP1, YES1, YPEL5, YTHDF3, Z24749, ZAK, ZBTB10, ZBTB24, ZBTB7A, ZC3H12C, ZC3H14, ZC3H18, ZCCHC11, ZEB1, ZEB2, ZFAND1, ZFAND5, ZHX3, ZMIZ1, ZMYM2, ZNF12, ZNF148, ZNF219, ZNF227, ZNF24, ZNF268, ZNF28, ZNF281, ZNF335, ZNF37A, ZNF37BP, ZNF395, ZNF583, ZNF621, ZNF652, ZNF655, ZNF674, ZNF74, ZNF764, ZNF778, ZNF780A, ZNF827, ZNF839 or ZNF91.

In another specific embodiment of the aspects and embodiments described herein, the gene is, or the RNA transcript is transcribed from a gene that is selected from: ABCB8, ANKRD36, APLP2, ARHGAP12, ARMCX6, ASAP1, ATG5, AXIN1, BIRC6, C1orf86, CDC42BPA, CLTA, DYRK1A, ERGIC3, FBXL6, FOXM1, GGCT, KAT6B, KDM6A, KIF3A, KMT2D, LARP7, LYRM1, MADD, MAN2C1, MRPL55, MYCBP2, MYO9B, PNISR, RAP1A, RAPGEF1, SENP6, SH3YL1, SLC25A17, SMN2, SREK1, STRN3, TAF2, TMEM134, VPS29, ZFAND1 or ZNF431.

In another specific embodiment of the aspects and embodiments described herein, the gene is, or the RNA transcript is transcribed from a gene that is selected from: ABCB8, ANKRD36, ARHGAP12, ARMCX6, ATG5, BIRC6, C1orf86, CLTA, DYRK1A, FBXL6, KAT6B, KDM6A, KMT2D, LYRM1, MAN2C1, MRPL55, MYCBP2, PNISR, RAPGEF1, SENP6, SH3YL1, TMEM134 or ZNF431.

In another specific embodiment of the aspects and embodiments described herein, the gene is, or the RNA transcript is transcribed from a gene that is selected from: ABCA10, ABCC1, ACTA2, ADAL, ADAM12, ADAMTS1, ADAMTS5, ADD1, ADGRG6, ADH6, ADHFE1, AFF2, AFF3, AGK, AGPS, AKAP3, ANK1, ANK2, ANK3, ANKRD33B, ANXA11, ANXA6, AP4B1-AS1, ARHGEF16, ARID5B, ARL9, ARMCX3, ASAP1, ASIC1, ATP2A3, B3GALT2, B3GNT6, BCL2L15, BCYRN1, BIN3-IT1, BIRC3, BTG2, C10orf54, C11orf70, C11orf73, C11orf94, C12orf56, C19orf47, C3, C4orf27, C7orf31, C8orf34, CA13, CA3, CACNA2D2, CACNB1, CADM1, CAND2, CCDC79, CCER2, CCNF, CDCA7, CDKAL1, CELSR1, CEMIP, CEP170, CFH, CIITA, CLDN23, CMAHP, CNGA4, CNTD1, COL11A1, COL12A1, COL14A1, COL15A1, COL5A1, COL5A3, COL6A6, COL8A1, COLEC12, COMP, CPA4, CPQ, CRISPLD2, CRLF1, CRYL1, CUX1, CYB5B, CYB5R2, CYGB, CYP1B1, DCLK1, DCN, DDIT4L, DDX42, DDX50, DEGS1, DENND1A, DENND5A, DEPTOR, DFNB59, DGKA, DHFR, DIAPH3, DIRAS3, DIS3L, DLG5, DNAH8, DNAJC27, DOCK1, DOCK11, DYNC1I1, DZIP1L, EBF1, EFEMP1, EGR3, EIF2B3, ELN, ELP4, EMX2OS, ENPP1, ERCC8, ESM1, EVC2, F2R, FAM160A1, FAM198B, FAM20A, FAM46B, FAM65B, FAP, FARP1, FBLN2, FBN2, FBXO9, FCHO1, FER, FGFR2, FGL2, FLT1, FRAS1, FSCN2, GAL3ST4, GALC, GALNT15, GATA6, GBGT1, GCNT1, GDF6, GNAQ, GOLGB1, GPR183, GPR50, GPRC5A, GPRC5B, GRTP1, GUCA1B, GXYLT1, HAPLN1, HAPLN2, HAS3, HAVCR2, HDAC5, HECTD2-AS1, HEPH, HEY1, HLTF, HMGN3-AS1, HMOX1, HOOK3, HSD17B12, HSPA1L, HTATIP2, HTT, IGDCC4, IGF2R, IGFBP3, IL16, INA, INTU, IQCG, ITGA11, ITGA8, ITGB8, ITIH1, ITPKA, KCNS1, KCNS2, KDM6A, KDSR, KIAA1456, KIAA1462, KIAA1524, KIAA1715, KIAA1755, KIT, KLF17, KLRG1, KRT7, KRTAP1-1, KRTAP1-5, L3MBTL2, LAMB2P1, LGI2, LGR4, LHX9, LINC00472, LINC00570, LINC00578, LINC00607, LINC00678, LINC00702, LINC00886, LINC00961, LINC01011, LINC01118, LINC01204, LMOD1, LRBA, LRP4, LRRC32, LRRC39, LSAMP, LUM, LYPD1, LYRM1, MAFB, MAMDC2, MAN1A2, MAN2A1, MAPK13, MASP1, MB, MC4R, MEDAG, MEGF6, MEMO1, MIAT, MIR612, MLLT10, MMP10, MMP24, MMS19, MN1, MOXD1, MRVI1, MSH4, MTERF3, MXRA5, MYO1D, NA, NAALADL2, NAE1, NAGS, NDNF, NEURL1B, NGFR, NHLH1, NLN, NOTCH3, NOTUM, NOVA2, NOX4, NRROS, NTNG1, OCLN, OLR1, OSBPL10, OXCT2, PAIP2B, PAPD4, PBLD, PCM1, PDE1C, PDE5A, PDGFD, PDGFRB, PDS5B, PDXDC1, PEAR1, PEPD, PHACTR3, PI4K2B, PIK3R1, PIM2, PITPNB, PITPNM3, PLAU, PLEK2, PLEKHA6, PLEKHH2, PLXNC1, PMS1, PODN, POLN, POLR1A, POSTN, PPM1E, PPP3CA, PRKCA, PRKDC, PRKG1, PRPH2, PRRG4, PRUNE2, PSMD6-AS2, PTGIS, PTX3, RAB30, RAB38, RAB44, RAD9B, RARS, RBBP8, RBKS, RCC1, RDX, RFWD2, RFX3-AS1, RGCC, RNFT1, ROR1, ROR2, RWDD4, SCARNA9, SCO1, SEC22A, SHROOM3, SIGLEC10, SLC24A3, SLC35F3, SLC39A10, SLC46A2, SLC4A11, SLC6A15, SLC7A11, SLC9A3, SLIT3, SMG1P3, SMTN, SMYD3, SNED1, SORBS2, SORCS2, SOX7, SPDYA, SPEF2, SQRDL, STAC2, STAT1, STAT4, STEAP2, STK32B, STRN4, STS, STXBP6, SULF1, SVEP1, SYNGR2, SYNPO, SYNPO2, SYNPO2L, TAGLN3, TANGO6, TARBP1, TEX21P, TGFA, TGFB2, TGFB3, TGM2, THADA, THBS2, THRB, TMEM102, TMEM119, TMEM256-PLSCR3, TMEM50B, TNC, TNFAIP8L3, TNFRSF14, TNRC18P1, TNS3, TNXB, TP53AIP1, TPRG1, TRAF3, TRIM66, TRPC4, TSHZ2, TSPAN11, TSPAN18, TSPAN7, TSSK3, TXNIP, UNC5B, USP27X, UVRAG, VIM-AS1, VPS41, VSTM2L, VWA8, VWF, WDR91, WISP1, WNT10B, XRN2, YDJC, ZBTB26, ZCCHC5, ZFP82, ZMIZ1-AS1, ZNF212, ZNF350, ZNF660, ZNF79 or ZNF837.

In another specific embodiment of the aspects and embodiments described herein, the gene is, or the RNA transcript is transcribed from a gene that is selected from: ABCA10, ACTA2, ADAL, ADAMTS1, ADAMTS5, ADD1, ADGRG6, ADH6, ADHFE1, AFF3, AKAP3, ANK1, ANK3, ANKRD33B, AP4B1-AS1, ARHGEF16, ARID5B, ARL9, ASIC1, ATP2A3, B3GALT2, B3GNT6, BCL2L15, BCYRN1, BIN3-IT1, BIRC3, BTG2, C10orf54, C11orf70, C11orf94, C12orf56, C19orf47, C3, C7orf31, C8orf34, CA13, CA3, CACNA2D2, CACNB1, CADM1, CAND2, CCDC79, CCER2, CCNF, CELSR1, CEMIP, CEP170, CFH, CIITA, CLDN23, CMAHP, CNGA4, CNTD1, COL11A1, COL14A1, COL15A1, COL5A1, COL5A3, COL6A6, COL8A1, COLEC12, COMP, CPA4, CPQ, CRISPLD2, CRLF1, CRYL1, CYB5R2, CYGB, CYP1B1, DCLK1, DCN, DDIT4L, DDX50, DEGS1, DEPTOR, DFNB59, DIRAS3, DLG5, DNAH8, DNAJC27, DOCK11, DYNC1I1, DZIP1L, EFEMP1, EGR3, ELN, ELP4, EMX2OS, ENPP1, ERCC8, ESM1, EVC2, F2R, FAM160A1, FAM20A, FAM46B, FAM65B, FAP, FARP1, FBLN2, FBN2, FBXO9, FCHO1, FGFR2, FGL2, FLT1, FRAS1, FSCN2, GAL3ST4, GALNT15, GATA6, GBGT1, GCNT1, GDF6, GNAQ, GPR183, GPR50, GPRC5A, GPRC5B, GRTP1, GUCA1B, GXYLT1, HAPLN1, HAPLN2, HAS3, HAVCR2, HDAC5, HECTD2-AS1, HEPH, HEY1, HMGN3-AS1, HOOK3, HSPA1L, HTATIP2, IGDCC4, IGF2R, IGFBP3, IL16, INA, INTU, IQCG, ITGA11, ITGA8, ITGB8, ITIH1, ITPKA, KCNS1, KCNS2, KDM6A, KDSR, KIAA1456, KIAA1462, KIAA1755, KIT, KLF17, KLRG1, KRT7, KRTAP1-1, KRTAP1-5, L3MBTL2, LAMB2P1, LGI2, LGR4, LHX9, LINC00472, LINC00570, LINC00578, LINC00607, LINC00678, LINC00702, LINC00886, LINC00961, LINC01011, LINC01118, LINC01204, LMOD1, LRBA, LRP4, LRRC32, LRRC39, LSAMP, LUM, LYPD1, MAFB, MAMDC2, MAN2A1, MAPK13, MASP1, MB, MC4R, MEGF6, MIAT, MIR612, MLLT10, MMP10, MMP24, MN1, MOXD1, MRVI1, MSH4, MTERF3, MXRA5, NA, NAALADL2, NAE1, NAGS, NDNF, NGFR, NHLH1, NLN, NOTCH3, NOTUM, NOVA2, NOX4, NRROS, OCLN, OLR1, OSBPL10, OXCT2, PAIP2B, PBLD, PDE1C, PDE5A, PDGFD, PDGFRB, PDS5B, PEAR1, PHACTR3, PI4K2B, PIK3R1, PIM2, PITPNM3, PLEK2, PLEKHA6, PLEKHH2, PODN, POLN, POLR1A, PPM1E, PPP3CA, PRKCA, PRKG1, PRPH2, PRRG4, PRUNE2, PSMD6-AS2, PTGIS, PTX3, RAB30, RAB38, RAB44, RAD9B, RARS, RBBP8, RBKS, RDX, RFX3-AS1, RGCC, ROR1, ROR2, SCARNA9, SHROOM3, SIGLEC10, SLC24A3, SLC35F3, SLC39A10, SLC46A2, SLC4A11, SLC6A15, SLC7A11, SLC9A3, SLIT3, SMG1P3, SMTN, SNED1, SORBS2, SORCS2, SOX7, SPDYA, SPEF2, STAC2, STAT4, STK32B, STRN4, STS, STXBP6, SULF1, SVEP1, SYNGR2, SYNPO, SYNPO2, SYNPO2L, TAGLN3, TANGO6, TEX21P, TGFA, TGFB2, TGFB3, TGM2, THBS2, TMEM102, TMEM119, TMEM256-PLSCR3, TMEM50B, TNFAIP8L3, TNFRSF14, TNRC18P1, TNXB, TP53AIP1, TPRG1, TRIM66, TRPC4, TSHZ2, TSPAN11, TSPAN18, TSPAN7, TSSK3, TXNIP, USP27X, UVRAG, VIM-AS1, VPS41, VSTM2L, VWF, WDR91, WISP1, WNT10B, YDJC, ZBTB26, ZCCHC5, ZFP82, ZMIZ1-AS1, ZNF212, ZNF350, ZNF660, ZNF79 or ZNF837.

In another specific embodiment of the aspects and embodiments described herein, the gene is, or the RNA transcript is transcribed from a gene that is selected from: ABCB8, ABCC3, ADAM17, ADCY3, AGPAT4, ANKRA2, ANXA11, APIP, APLP2, APLP2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DAGLB, DCAF17, DCUN1D4, DDX42, DENND1A, DENND5A, DGKA, DHFR, DIAPH3, DLGAP4, DNAJC13, DNMBP, DOCK1, DYRK1A, EIF2B3, ENAH, ENOX1, EP300, ERC1, ERCC1, ERGIC3, ERLIN2, ERRFI1, EVC, FAF1, FAIM, FAM126A, FAM13A, FAM162A, FAM174A, FAM198B, FBN2, FER, FHOD3, FOCAD, GALC, GCFC2, GGACT, GGCT, GLCE, GOLGA4, GOLGB1, GPSM2, GULP1, GXYLT1, HAT1, HDX, HLTF, HMGA2, HNMT, HPS1, HSD17B12, HSD17B4, HTT, IFT57, INPP5K, IVD, KDM6A, KIAA1524, KIAA1715, LETM2, LOC400927, LRRC42, LUC7L3, LYRM1, MADD, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPHLN1, PPIP5K2, PPP1R26, PRPF31, PRSS23, PRUNE2, PSMA4, PXK, RAF1, RAP1A, RAPGEF1, RARS2, RBKS, RERE, RFWD2, RNFT1, RPA1, RPS10, RPS6KB2, SAMD4A, SAR1A, SCO1, SEC24A, SENP6, SERGEF, SGK3, SH3YL1, SKA2, SLC12A2, SLC25A17, SLC44A2, SMYD3, SNAP23, SNHG16, SNX7, SOS2, SPATA18, SPATA5, SPIDR, SPRYD7, SRGAP1, SRRM1, STAT1, STRN3, STXBP6, SUPT20H, TAF2, TASP1, TBC1D15, TCF12, TCF4, TIAM1, TJP2, TMC3, TMEM189-UBE2V1, TMEM214, TNRC6A, TNS3, TOE1, TRAF3, TRIM65, TSPAN2, TTC7B, TUBE1, TYW5, UBAP2L, UBE2V1, URGCP, VAV2, VPS29, WDR27, WDR37, WDR91, WNK1, XRN2, ZCCHC8, ZFP82, ZNF138, ZNF232, ZNF37BP or ZNF680.

In another specific embodiment of the aspects and embodiments described herein, the gene is, or the RNA transcript is transcribed from a gene that is selected from: ABCB8, ABCC3, ADAM17, ADCY3, AGPAT4, ANKRA2, ANXA11, APIP, APPL2, ARHGAP1, ARL15, ASAP1, ASPH, ATAD2B, ATXN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, ENOX1, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 or ZNF37BP.

In another specific embodiment of the aspects and embodiments described herein, the gene is, or the RNA transcript is transcribed from a gene that is selected from: APLP2, AXIN1, CECR7, DAGLB, DLGAP4, ERCC1, ERGIC3, FAM198B, GGCT, HAT1, HPS1, INPP5K, MADD, PPHLN1, PRUNE2, RAP1A, RNFT1, RPS6KB2, SH3YL1, SKA2, SPATA18, STRN3, TMEM189-UBE2V1, TRIM65, TUBE1, UBE2V1, VPS29 or ZNF680.

In another specific embodiment of the aspects and embodiments described herein, the gene is, or the RNA transcript is transcribed from a gene that is selected from: ABCB8, ABCC3, ADCY3, AGPAT4, ANKRA2, APIP, ARHGAP1, ARL15, ATXN1, BECN1, BHMT2, BTN3A1, C12orf4, C14orf132, C8orf44, C8orf44-SGK3, C8orf88, CASP7, CCDC122, CECR7, CENPI, CEP112, CEP192, CHEK1, CMAHP, CNRIP1, CPSF4, CRISPLD2, CRYBG3, CSNK1E, CSNK1G1, DAGLB, DCAF17, DLGAP4, DNAJC13, DNMBP, DYRK1A, ENAH, EP300, ERCC1, ERLIN2, ERRFI1, EVC, FAIM, FAM126A, FAM13A, FAM162A, FAM174A, FBN2, GGACT, GLCE, GULP1, GXYLT1, HDX, HMGA2, HNMT, HPS1, IFT57, INPP5K, IVD, KDM6A, LETM2, LOC400927, LRRC42, LYRM1, MB21D2, MCM10, MED13L, MFN2, MRPL45, MRPS28, MTERF3, MYCBP2, NGF, OXCT1, PDS5B, PIGN, PIK3CD, PIK3R1, PIKFYVE, PLEKHA1, PLSCR1, POMT2, PPARG, PPIP5K2, PPP1R26, PRPF31, PRUNE2, PXK, RAF1, RAPGEF1, RARS2, RBKS, RERE, RPA1, RPS10, RPS6KB2, SAMD4A, SEC24A, SENP6, SERGEF, SGK3, SH3YL1, SKA2, SLC12A2, SLC44A2, SNX7, SPATA18, SPATA5, SPIDR, SPRYD7, SRGAP1, SRRM1, STXBP6, TASP1, TCF12, TCF4, TIAM1, TMC3, TMEM189-UBE2V1, TMEM214, TNRC6A, TTC7B, TUBE1, TYW5, URGCP, VAV2, WDR27, WDR91, WNK1, ZCCHC8, ZFP82, ZNF138, ZNF232 or ZNF680.

In another aspect, provide herein is a method of modulating the amount and type of a protein produced by a cell containing the artificial gene construct as described above, the method comprising contacting the cell with a compound of Formula (I) or a form thereof, wherein Formula (I) is

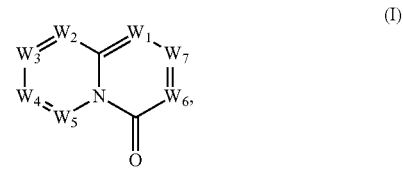

wherein:
w$_1$ and w$_5$ are independently C—R$_a$ or N;
w$_2$ is C—R$_b$ or N;
w$_3$, w$_4$ and w$_7$ are independently C—R$_1$, C—R$_2$, C—R$_a$ or N;
w$_6$ is C—R$_1$, C—R$_2$, C—R$_c$ or N;
wherein one of w$_3$, w$_4$, w$_6$ and w$_7$ is C—R$_1$ and one other of w$_3$, w$_4$, w$_6$ and w$_7$ is C—R$_2$, provided that,
when w$_3$ is C—R$_1$, then w$_6$ is C—R$_2$ and w$_4$ and w$_7$ are independently C—R$_a$ or N; or,
when w$_3$ is C—R$_2$, then w$_6$ is C—R$_1$ and w$_4$ and w$_7$ are independently C—R$_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N; and, wherein any one, two or three of $w_1$, $w_2$, $w_3$, $w_4$, $w_5$, $w_6$ and $w_7$ may optionally be N;

$R_1$ is $C_{1-8}$alkyl, amino, $C_{1-8}$alkyl-amino, $(C_{1-8}$alkyl$)_2$-amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl$)$amino, amino-$C_{1-8}$alkyl, $C_{1-8}$alkyl-amino-$C_{1-8}$alkyl, $(C_{1-8}$alkyl$)_2$-amino-$C_{1-8}$alkyl, $C_{1-8}$alkoxy-$C_{1-8}$alkyl-amino-$C_{1-8}$alkyl, $(C_{1-8}$alkoxy-$C_{1-8}$alkyl$)_2$-amino-$C_{1-8}$alkyl, $(C_{1-8}$alkoxy-$C_{1-8}$alkyl$)(C_{1-8}$alkyl$)$amino-$C_{1-8}$alkyl, amino-$C_{1-8}$alkyl-amino, (amino-$C_{1-8}$alkyl$)_2$-amino, (amino-$C_{1-8}$alkyl$)(C_{1-8}$alkyl$)$amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl-amino-$C_{1-8}$alkyl$)(C_{1-8}$alkyl$)$amino, $(C_{1-8}$alkyl$)_2$-amino-$C_{1-8}$alkyl-amino, $[(C_{1-8}$alkyl$)_2$-amino-$C_{1-8}$alkyl$](C_{1-8}$alkyl$)$amino, amino-$C_{1-8}$alkoxy, $C_{1-8}$alkyl-amino-$C_{1-8}$alkoxy, $(C_{1-8}$alkyl$)_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, $(C_{1-8}$alkoxy-$C_{1-8}$alkyl$)(C_{1-8}$alkyl$)$amino-$C_{1-8}$alkoxy, amino-$C_{2-8}$alkenyl, $C_{1-8}$alkyl-amino-$C_{2-8}$alkenyl, $(C_{1-8}$alkyl$)_2$-amino-$C_{2-8}$alkenyl, amino-$C_{2-8}$alkynyl, $C_{1-8}$alkyl-amino-$C_{2-8}$alkynyl, $(C_{1-8}$alkyl$)_2$-amino-$C_{2-8}$alkynyl, halo-$C_{1-8}$alkyl-amino, (halo-$C_{1-8}$alkyl$)_2$-amino, (halo-$C_{1-8}$alkyl$)(C_{1-8}$alkyl$)$amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino, (hydroxy-$C_{1-8}$alkyl$)(C_{1-8}$alkyl$)$amino, hydroxy-$C_{1-8}$alkyl-amino-$C_{1-8}$alkyl, (hydroxy-$C_{1-8}$alkyl$)_2$-amino-$C_{1-8}$alkyl, (hydroxy-$C_{1-8}$alkyl$)(C_{1-8}$alkyl$)$amino-$C_{1-8}$alkyl, hydroxy-$C_{1-8}$alkyl-amino-$C_{1-8}$alkoxy, (hydroxy-$C_{1-8}$alkyl$)_2$-amino-$C_{1-8}$alkoxy, (hydroxy-$C_{1-8}$alkyl$)(C_{1-8}$alkyl$)$amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl$)_2$-amino, (hydroxy-$C_{1-8}$alkyl$)_2$-amino-$C_{1-8}$alkyl-amino, (hydroxy-$C_{1-8}$alkyl-amino-$C_{1-8}$alkyl$)(C_{1-8}$alkyl$)$amino, (hydroxy-$C_{1-8}$alkyl$)(C_{1-8}$alkyl$)$amino-$C_{1-8}$alkyl-amino, $[($hydroxy-$C_{1-8}$alkyl$)_2$-amino-$C_{1-8}$alkyl$](C_{1-8}$alkyl$)$amino, $[($hydroxy-$C_{1-8}$alkyl$)(C_{1-8}$alkyl$)$amino-$C_{1-8}$alkyl$](C_{1-8}$alkyl$)$amino, heterocyclyl, heterocyclyl-$C_{1-8}$alkyl, heterocyclyl-$C_{1-8}$alkoxy, heterocyclyl-amino, (heterocyclyl$)(C_{1-8}$alkyl$)$amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl$)(C_{1-8}$alkyl$)$amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl$)(C_{1-8}$alkyl$)$amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl$)_2$-amino, (aryl-$C_{1-8}$alkyl$)(C_{1-8}$alkyl$)$amino, aryl-$C_{1-8}$alkyl-amino-$C_{1-8}$alkyl, (aryl-$C_{1-8}$alkyl$)_2$-amino-$C_{1-8}$alkyl, (aryl-$C_{1-8}$alkyl$)(C_{1-8}$alkyl$)$amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl$)(C_{1-8}$alkyl$)$amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl$)(C_{1-8}$alkyl$)$amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, $(C_{1-8}$alkyl$)_2$-amino, amino-$C_{1-8}$alkyl, $C_{1-8}$alkyl-amino-$C_{1-8}$alkyl, $(C_{1-8}$alkyl$)_2$-amino-$C_{1-8}$alkyl, amino-$C_{1-8}$alkyl-amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl$)_2$-amino-$C_{1-8}$alkyl-amino, $[(C_{1-8}$alkyl$)_2$-amino-$C_{1-8}$alkyl$]_2$-amino, $(C_{1-8}$alkyl-amino-$C_{1-8}$alkyl$)(C_{1-8}$alkyl$)$amino, $[(C_{1-8}$alkyl$)_2$-amino-$C_{1-8}$alkyl$](C_{1-8}$alkyl$)$amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl$)$amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino or (hydroxy-$C_{1-8}$alkyl$)(C_{1-8}$alkyl$)$amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, $(C_{1-8}$alkyl$)_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, $(C_{1-8}$alkyl$)_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In a specific embodiment, in the context of DNA, the nucleotide sequence encoding the intronic REMS comprises a sequence selected from the group consisting of ANGAgtrngn (SEQ ID NO: 1829), CNGAgtrngn (SEQ ID NO: 1835), GNGAgtrngn (SEQ ID NO: 1841), TNGAgtrngn (SEQ ID NO: 1847), NAGAgtrngn (SEQ ID NO: 1830), NCGAgtrngn (SEQ ID NO: 1836), NGGAgtrngn (SEQ ID NO: 1842), NTGAgtrngn (SEQ ID NO: 1848), AAGAgtrngn (SEQ ID NO: 1831), ACGAgtrngn (SEQ ID NO: 1837), AGGAgtrngn (SEQ ID NO: 1843), ATGAgtrngn (SEQ ID NO: 1849), CAGAgtrngn (SEQ ID NO: 1832), CCGAgtrngn (SEQ ID NO: 1838), CGGAgtrngn (SEQ ID NO: 1844), CTGAgtrngn (SEQ ID NO: 1850), GAGAgtrngn (SEQ ID NO: 1833), GCGAgtrngn (SEQ ID NO: 1839), GGGAgtrngn (SEQ ID NO: 1845), GTGAgtrngn (SEQ ID NO: 1851), TAGAgtrngn (SEQ ID NO: 1834), TCGAgtrngn (SEQ ID NO: 1840), TGGAgtrngn (SEQ ID NO: 1846) and TTGAgtrngn (SEQ ID NO: 1852), wherein r is adenine or guanine and n or N is any nucleotide.

In a further specific embodiment, in the context of DNA, the nucleotide sequence encoding the intronic REMS comprises a sequence selected from the group consisting of ANGAgtragt (SEQ ID NO: 2237), CNGAgtragt (SEQ ID NO: 2243), GNGAgtragt (SEQ ID NO: 2249), TNGAgtragt (SEQ ID NO: 2255), NAGAgtragt (SEQ ID NO: 2238), NCGAgtragt (SEQ ID NO: 2244), NGGAgtragt (SEQ ID NO: 2250), NTGAgtragt (SEQ ID NO: 2256), AAGAgtragt (SEQ ID NO: 2239), ACGAgtragt (SEQ ID NO: 2245), AGGAgtragt (SEQ ID NO: 2251), ATGAgtragt (SEQ ID NO: 2257), CAGAgtragt (SEQ ID NO: 2240), CCGAgtragt (SEQ ID NO: 2246), CGGAgtragt (SEQ ID NO: 2252), CTGAgtragt (SEQ ID NO: 2258), GAGAgtragt (SEQ ID NO: 2241), GCGAgtragt (SEQ ID NO: 2247), GGGAgtragt (SEQ ID NO: 2253), GTGAgtragt (SEQ ID NO: 2259), TAGAgtragt (SEQ ID NO: 2242), TCGAgtragt (SEQ ID NO: 2248), TGGAgtragt (SEQ ID NO: 2254) and TTGAgtragt (SEQ ID NO: 2260), wherein r is adenine or guanine and N is any nucleotide. In one or more embodiments provided herein, N is adenine or guanine.

In various specific embodiments, the nucleotide sequence encoding the intronic REMS is a nucleotide sequence encoding a non-endogenous intronic REMS, i.e., a precursor RNA transcript comprising the non-endogenous intronic REMS not naturally found in the DNA sequence of the artificial construct.

In one aspect, provided herein is a method for modulating the amount of an RNA transcript comprising a RNA nucleotide sequence comprising in 5' to 3' order: a branch point, a 3' splice site and an endogenous intronic recognition element for splicing modifier (iREMS), wherein the iREMS comprises an RNA sequence GAgurngn (SEQ ID NO: 2), wherein r is adenine or guanine and n is any nucleotide, and wherein the RNA transcript is an RNA transcript of a gene that is selected from: ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1U1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837; the method comprising contacting the RNA transcript with a compound of Formula (I) or a form thereof, wherein Formula (I) is:

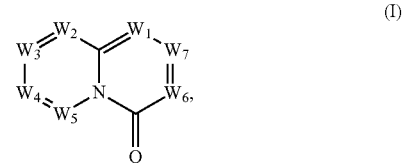

(I)

wherein:

$w_1$ and $w_5$ are independently C—$R_a$ or N;

$w_2$ is C—$R_b$ or N;

$w_3$, $w_4$ and $w_7$ are independently C—$R_1$, C—$R_2$, C—$R_a$ or N;

$w_6$ is C—$R_1$, C—$R_2$, C—$R_c$ or N;

wherein one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N; and, wherein any one, two or three of $w_1$, $w_2$, $w_3$, $w_4$, $w_5$, $w_6$ and $w_7$ may optionally be N;

$R_1$ is $C_{1-8}$alkyl, amino, $C_{1-8}$alkyl-amino, $(C_{1-8}$alkyl$)_2$-amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl$)$amino, amino-$C_{1-8}$alkyl, $C_{1-8}$alkyl-amino-$C_{1-8}$alkyl, $(C_{1-8}$alkyl$)_2$-amino-$C_{1-8}$alkyl, $C_{1-8}$alkoxy-$C_{1-8}$alkyl-amino-$C_{1-8}$alkyl, $(C_{1-8}$alkoxy-$C_{1-8}$alkyl$)_2$-amino-$C_{1-8}$alkyl, $(C_{1-8}$alkoxy-$C_{1-8}$alkyl$)(C_{1-8}$alkyl$)$amino-$C_{1-8}$alkyl, amino-$C_{1-8}$alkyl-amino, (amino-$C_{1-8}$alkyl$)_2$-amino, (amino-$C_{1-8}$alkyl$)(C_{1-8}$alkyl$)$amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl-amino-$C_{1-8}$alkyl$)(C_{1-8}$alkyl$)$amino, $(C_{1-8}$alkyl$)_2$-amino-$C_{1-8}$alkyl-amino, $[(C_{1-8}$alkyl$)_2$-amino-$C_{1-8}$alkyl$](C_{1-8}$alkyl$)$amino, amino-$C_{1-8}$alkoxy, $C_{1-8}$alkyl-amino-$C_{1-8}$alkoxy, $(C_{1-8}$alkyl$)_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, $(C_{1-8}$alkoxy-$C_{1-8}$alkyl$)(C_{1-8}$alkyl$)$amino-$C_{1-8}$alkoxy, amino-$C_{2-8}$alkenyl, $C_{1-8}$alkyl-amino-$C_{2-8}$alkenyl, $(C_{1-8}$alkyl$)_2$-amino-$C_{2-8}$alkenyl, amino-$C_{2-8}$alkynyl, $C_{1-8}$alkyl-amino-$C_{2-8}$alkynyl, $(C_{1-8}$alkyl$)_2$-amino-$C_{2-8}$alkynyl, halo-$C_{1-8}$alkyl-amino, (halo-$C_{1-8}$alkyl$)_2$-amino, (halo-$C_{1-8}$alkyl$)(C_{1-8}$alkyl$)$amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino, (hydroxy-$C_{1-8}$alkyl$)(C_{1-8}$alkyl$)$amino, hydroxy-$C_{1-8}$alkyl-amino-$C_{1-8}$alkyl, (hydroxy-$C_{1-8}$alkyl$)_2$-amino-$C_{1-8}$alkyl, (hydroxy-$C_{1-8}$alkyl$)(C_{1-8}$alkyl$)$amino-$C_{1-8}$alkyl, hydroxy-$C_{1-8}$alkyl-amino-$C_{1-8}$alkoxy, (hydroxy-$C_{1-8}$alkyl$)_2$-amino-$C_{1-8}$alkoxy, (hydroxy-$C_{1-8}$alkyl$)(C_{1-8}$alkyl$)$amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl$)_2$-amino, (hydroxy-$C_{1-8}$alkyl$)_2$-amino-$C_{1-8}$alkyl-amino, (hydroxy-$C_{1-8}$alkyl-amino-$C_{1-8}$alkyl$)(C_{1-8}$alkyl$)$amino, (hydroxy-$C_{1-8}$alkyl$)(C_{1-8}$alkyl$)$amino-$C_{1-8}$alkyl-amino, $[($hydroxy-$C_{1-8}$alkyl$)_2$-amino-$C_{1-8}$alkyl$](C_{1-8}$alkyl$)$amino, $[($hydroxy-$C_{1-8}$alkyl$)(C_{1-8}$alkyl$)$amino-$C_{1-8}$alkyl$](C_{1-8}$alkyl$)$amino, heterocyclyl, heterocyclyl-$C_{1-8}$alkyl, heterocyclyl-$C_{1-8}$alkoxy, heterocyclyl-amino, (heterocyclyl)$(C_{1-8}$alkyl$)$amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl$)(C_{1-8}$alkyl$)$amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl$)(C_{1-8}$alkyl$)$amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl$)_2$-amino, (aryl-$C_{1-8}$alkyl$)(C_{1-8}$alkyl$)$amino, aryl-$C_{1-8}$alkyl-amino-$C_{1-8}$alkyl, (aryl-$C_{1-8}$alkyl$)_2$-amino-$C_{1-8}$alkyl, (aryl-$C_{1-8}$alkyl)$(C_{1-8}$alkyl$)$amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl$)(C_{1-8}$alkyl$)$amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl)$(C_{1-8}$alkyl$)$amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, $(C_{1-8}$alkyl$)_2$-amino, amino-$C_{1-8}$alkyl, $C_{1-8}$alkyl-amino-$C_{1-8}$alkyl, $(C_{1-8}$alkyl$)_2$-amino-$C_{1-8}$alkyl, amino-$C_{1-8}$alkyl-amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl$)_2$-amino-$C_{1-8}$alkyl-amino, $[(C_{1-8}$alkyl$)_2$-amino-$C_{1-8}$alkyl$]_2$-amino, $(C_{1-8}$alkyl-amino-$C_{1-8}$alkyl$)(C_{1-8}$alkyl$)$amino, $[(C_{1-8}$alkyl$)_2$-amino-$C_{1-8}$alkyl$](C_{1-8}$alkyl$)$amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl$)$amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino or (hydroxy-$C_{1-8}$alkyl$)(C_{1-8}$alkyl$)$amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, $(C_{1-8}$alkyl$)_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, $(C_{1-8}$alkyl$)_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In another aspect, provided herein is a method for modulating the amount of an RNA transcript comprising a RNA nucleotide sequence comprising in 5' to 3' order: a branch point, a 3' splice site and an endogenous intronic recognition element for splicing modifier (iREMS); wherein the iREMS comprises an RNA sequence GAgurngn (SEQ ID NO: 2), wherein r is adenine or guanine and n is any nucleotide, and wherein the RNA transcript is an RNA transcript of a gene not disclosed in either International Publication No. WO 2015/105657, International Publication No. WO 2016/196386, or both; the method comprising contacting the RNA transcript with a compound of Formula (I) or a form thereof, wherein Formula (I) is:

$$\text{(I)}$$

wherein:
$w_1$ and $w_5$ are independently C—$R_a$ or N;
$w_2$ is C—$R_b$ or N;
$w_3$, $w_4$ and $w_7$ are independently C—$R_1$, C—$R_2$, C—$R_a$ or N;
$w_6$ is C—$R_1$, C—$R_2$, C—$R_c$ or N;
wherein one of $w_3$, $w_4$, $w_6$ and $w_7$ is C—$R_1$ and one other of $w_3$, $w_4$, $w_6$ and $w_7$ is C—$R_2$, provided that,
when $w_3$ is C—$R_1$, then $w_6$ is C—$R_2$ and $w_4$ and $w_7$ are independently C—$R_a$ or N; or,
when $w_3$ is C—$R_2$, then $w_6$ is C—$R_1$ and $w_4$ and $w_7$ are independently C—$R_a$ or N; or,
when $w_4$ is C—$R_1$, then $w_7$ is C—$R_2$ and $w_3$ is C—$R_a$ or N and $w_6$ is C—$R_c$ or N; or,
when $w_4$ is C—$R_2$, then $w_7$ is C—$R_1$ and $w_3$ is C—$R_a$ or N and $w_6$ is C—$R_c$ or N; and,
wherein any one, two or three of $w_1$, $w_2$, $w_3$, $w_4$, $w_5$, $w_6$ and $w_7$ may optionally be N;
$R_1$ is $C_{1-8}$alkyl, amino, $C_{1-8}$alkyl-amino, $(C_{1-8}$alkyl$)_2$-amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl)amino, amino-$C_{1-8}$alkyl, $C_{1-8}$alkyl-amino-$C_{1-8}$alkyl, $(C_{1-8}$alkyl$)_2$-amino-$C_{1-8}$alkyl, $C_{1-8}$alkoxy-$C_{1-8}$alkyl-amino-$C_{1-8}$alkyl, $(C_{1-8}$alkoxy-$C_{1-8}$alkyl$)_2$-amino-$C_{1-8}$alkyl, $(C_{1-8}$alkoxy-$C_{1-8}$alkyl$)(C_{1-8}$alkyl)amino-$C_{1-8}$alkyl, amino-$C_{1-8}$alkyl-amino, (amino-$C_{1-8}$alkyl$)_2$-amino, (amino-$C_{1-8}$alkyl$)(C_{1-8}$alkyl)amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl-amino-$C_{1-8}$alkyl$)(C_{1-8}$alkyl)amino, $(C_{1-8}$alkyl$)_2$-amino-$C_{1-8}$alkyl-amino, $[(C_{1-8}$alkyl$)_2$-amino-$C_{1-8}$alkyl$](C_{1-8}$alkyl)amino, amino-$C_{1-8}$alkoxy, $C_{1-8}$alkyl-amino-$C_{1-8}$alkoxy, $(C_{1-8}$alkyl$)_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, $(C_{1-8}$alkoxy-$C_{1-8}$alkyl$)(C_{1-8}$alkyl)amino-$C_{1-8}$alkoxy, amino-$C_{2-8}$alkenyl, $C_{1-8}$alkyl-amino-$C_{2-8}$alkenyl, $(C_{1-8}$alkyl$)_2$-amino-$C_{2-8}$alkenyl, amino-$C_{2-8}$alkynyl, $C_{1-8}$alkyl-amino-$C_{2-8}$alkynyl, $(C_{1-8}$alkyl$)_2$-amino-$C_{2-8}$alkynyl, halo-$C_{1-8}$alkyl-amino, (halo-$C_{1-8}$alkyl$)_2$-amino, (halo-$C_{1-8}$alkyl$)(C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino, (hydroxy-$C_{1-8}$alkyl$)(C_{1-8}$alkyl)amino, hydroxy-$C_{1-8}$alkyl-amino-$C_{1-8}$alkyl, (hydroxy-$C_{1-8}$alkyl$)_2$-amino-$C_{1-8}$alkyl, (hydroxy-$C_{1-8}$alkyl$)(C_{1-8}$alkyl)amino-$C_{1-8}$alkyl, hydroxy-$C_{1-8}$alkyl-amino-$C_{1-8}$alkoxy, (hydroxy-$C_{1-8}$alkyl$)_2$-amino-$C_{1-8}$alkoxy, (hydroxy-$C_{1-8}$alkyl$)(C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl$)_2$-amino, (hydroxy-$C_{1-8}$alkyl-amino-$C_{1-8}$alkyl)$C_{1-8}$alkyl-amino, (hydroxy-$C_{1-8}$alkyl-amino-$C_{1-8}$alkyl)$(C_{1-8}$alkyl)amino, (hydroxy-$C_{1-8}$alkyl$)(C_{1-8}$alkyl) amino-$C_{1-8}$alkyl-amino, [(hydroxy-$C_{1-8}$alkyl$)_2$-amino-$C_{1-8}$alkyl$](C_{1-8}$alkyl)amino, [(hydroxy-$C_{1-8}$alkyl)$(C_{1-8}$alkyl)amino-$C_{1-8}$alkyl$](C_{1-8}$alkyl)amino, heterocyclyl, heterocyclyl-$C_{1-8}$alkyl, heterocyclyl-$C_{1-8}$alkoxy, heterocyclyl-amino, (heterocyclyl)$(C_{1-8}$alkyl)amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl)$(C_{1-8}$alkyl)amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl)$(C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl$)_2$-amino, (aryl-$C_{1-8}$alkyl)$(C_{1-8}$alkyl)amino, aryl-$C_{1-8}$alkyl-amino-$C_{1-8}$alkyl, (aryl-$C_{1-8}$alkyl$)_2$-amino-$C_{1-8}$alkyl, (aryl-$C_{1-8}$alkyl)$(C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl)$(C_{1-8}$alkyl)amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl)$(C_{1-8}$alkyl)amino-$C_{1-8}$alkyl;
wherein, each instance of heterocyclyl, $C_{3-14}$cycloalkyl, aryl and heteroaryl is optionally substituted with one, two or three $R_3$ substituents and optionally, with one additional $R_4$ substituent; or,
wherein, each instance of heterocyclyl, $C_{3-14}$cycloalkyl, aryl and heteroaryl is optionally substituted with one, two, three or four $R_3$ substituents;
$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;
$R_a$ is, in each instance, independently selected from hydrogen, halogen, $C_{1-8}$alkyl or deuterium;
$R_b$ is hydrogen, halogen, $C_{1-8}$alkyl, $C_{1-8}$alkoxy or deuterium;
$R_c$ is hydrogen, halogen, $C_{1-8}$alkyl or deuterium;
$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, $(C_{1-8}$alkyl$)_2$-amino, amino-$C_{1-8}$alkyl, $C_{1-8}$alkyl-amino-$C_{1-8}$alkyl, $(C_{1-8}$alkyl$)_2$-amino-$C_{1-8}$alkyl, amino-$C_{1-8}$alkyl-amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl$)_2$-amino-$C_{1-8}$alkyl-amino, $[(C_{1-8}$alkyl$)_2$-amino-$C_{1-8}$alkyl$]_2$-amino, $(C_{1-8}$alkyl-amino-$C_{1-8}$alkyl)$(C_{1-8}$alkyl)amino, $[(C_{1-8}$alkyl$)_2$-amino-$C_{1-8}$alkyl$](C_{1-8}$alkyl)amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl)$(C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino or (hydroxy-$C_{1-8}$alkyl)$(C_{1-8}$alkyl)amino;
$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;
$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, $(C_{1-8}$alkyl$)_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In another aspect, provided herein is a method for modulating the amount of an RNA transcript comprising a RNA nucleotide sequence comprising in 5' to 3' order: a branch point, a 3' splice site and a non-endogenous intronic recognition element for splicing modifier (iREMS); wherein the iREMS comprises an RNA sequence GAgurngn (SEQ ID NO: 2), wherein r is adenine or guanine and n is any nucleotide, the method comprising contacting the RNA transcript with a compound of Formula (I) or a form thereof, wherein Formula (I) is:

$$\text{(I)}$$

wherein:

$w_1$ and $w_5$ are independently C—$R_a$ or N;

$w_2$ is C—$R_b$ or N;

$w_3$, $w_4$ and $w_7$ are independently C—$R_1$, C—$R_2$, C—$R_a$ or N;

$w_6$ is C—$R_1$, C—$R_2$, C—$R_c$ or N;

wherein one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N; and, wherein any one, two or three of $w_1$, $w_2$, $w_3$, $w_4$, $w_5$, $w_6$ and $w_7$ may optionally be N;

$R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In certain embodiments, the iREMS comprises an RNA sequence GAguragu (SEQ ID NO: 3866), wherein r is adenine or guanine and n is any nucleotide. In some embodiments, the iREMS comprises an RNA sequence NNGAgurngn (SEQ ID NO: 1), wherein r is adenine or guanine and n or N is any nucleotide. In a specific embodiment, the RNA sequence NNGAgurngn (SEQ ID NO: 1) is selected from the group consisting of ANGAgurngn (SEQ ID NO: 29), CNGAgurngn (SEQ ID NO: 35), GNGAgurngn (SEQ ID NO: 41), UNGAgurngn (SEQ ID NO: 47), NAGAgurngn (SEQ ID NO: 30), NCGAgurngn (SEQ ID NO: 36), NGGAgurngn (SEQ ID NO: 42), NUGAgurngn (SEQ ID NO: 48), AAGAgurngn (SEQ ID NO: 31), ACGAgurngn (SEQ ID NO: 37), AGGAgurngn (SEQ ID NO: 43), AUGAgurngn (SEQ ID NO: 49), CAGAgurngn (SEQ ID NO: 32), CCGAgurngn (SEQ ID NO: 38), CGGAgurngn (SEQ ID NO: 44), CUGAgurngn (SEQ ID NO: 50), GAGAgurngn (SEQ ID NO: 33), GCGAgurngn (SEQ ID NO: 39), GGGAgurngn (SEQ ID NO: 45), GUGAgurngn (SEQ ID NO: 51), UAGAgurngn (SEQ ID NO: 34), UCGAgurngn (SEQ ID NO: 40), UGGAgurngn (SEQ ID NO: 46) and UUGAgurngn (SEQ ID NO: 52), wherein r is adenine or guanine and n or N is any nucleotide. In certain embodiments, n is adenine or guanine.

In certain embodiments, the iREMS comprises an RNA sequence NNGAguragu (SEQ ID NO: 3862), wherein r is adenine or guanine and N is any nucleotide. In a specific embodiment, the RNA sequence NNGAguragu (SEQ ID NO: 3862) is selected from the group consisting of ANGAguragu (SEQ ID NO: 437), CNGAguragu (SEQ ID NO: 443), GNGAguragu (SEQ ID NO: 449), UNGAguragu (SEQ ID NO: 455), NAGAguragu (SEQ ID NO: 438), NCGAguragu (SEQ ID NO: 444), NGGAguragu (SEQ ID NO: 450), NUGAguragu (SEQ ID NO: 456), AAGAguragu (SEQ ID NO: 439), ACGAguragu (SEQ ID NO: 445), AGGAguragu (SEQ ID NO: 451), AUGAguragu (SEQ ID NO: 457), CAGAguragu (SEQ ID NO: 440), CCGAguragu (SEQ ID NO: 446), CGGAguragu (SEQ ID NO: 452), CUGAguragu (SEQ ID NO: 458), GAGAguragu (SEQ ID NO: 441), GCGAguragu (SEQ ID NO: 447), GGGAguragu (SEQ ID NO: 453), GUGAguragu (SEQ ID NO: 459), UAGAguragu (SEQ ID NO: 442), UCGAguragu (SEQ ID NO: 448), UGGAguragu (SEQ ID NO: 454) and UUGAguragu (SEQ ID NO: 460), wherein r is adenine or guanine, and N is any nucleotide. the iREMS comprises an RNA sequence presented in Table 13. In certain embodiments, n is adenine or guanine.

In another aspect, provided herein is a method for modulating the amount of an RNA transcript produced from a DNA sequence comprising a DNA nucleotide sequence encoding exons and one or more introns, comprising in 5' to 3' order: a branch point, a 3' splice site and an endogenous iREMS; wherein the iREMS comprises a DNA sequence GAgtrngn (SEQ ID NO: 4), wherein r is adenine or guanine and n is any nucleotide, the method comprising contacting the RNA transcript with a compound of Formula (I) or a form thereof, wherein Formula (I) is:

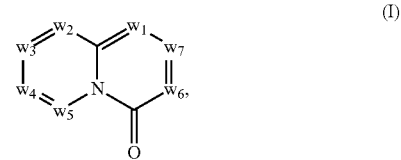

(I)

wherein:
$w_1$ and $w_5$ are independently C—$R_a$ or N;
$w_2$ is C—$R_b$ or N;
$w_3$, $w_4$ and $w_7$ are independently C—$R_1$, C—$R_2$, C—$R_a$ or N;
$w_6$ is C—$R_1$, C—$R_2$, C—$R_c$ or N;
wherein one of $w_3$, $w_4$, $w_6$ and $w_7$ is C—$R_1$ and one other of $w_3$, $w_4$, $w_6$ and $w_7$ is C—$R_2$, provided that,
when $w_3$ is C—$R_1$, then $w_6$ is C—$R_2$ and $w_4$ and $w_7$ are independently C—$R_a$ or N; or,
when $w_3$ is C—$R_2$, then $w_6$ is C—$R_1$ and $w_4$ and $w_7$ are independently C—$R_a$ or N; or,
when $w_4$ is C—$R_1$, then $w_7$ is C—$R_2$ and $w_3$ is C—$R_a$ or N and $w_6$ is C—$R_c$ or N; or,
when $w_4$ is C—$R_2$, then $w_7$ is C—$R_1$ and $w_3$ is C—$R_a$ or N and $w_6$ is C—$R_c$ or N; and,
wherein any one, two or three of $w_1$, $w_2$, $w_3$, $w_4$, $w_5$, $w_6$ and $w_7$ may optionally be N;

$R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)

($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In a specific embodiment, the DNA sequence is in a gene selected from: ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837. In another specific embodiment, the DNA sequence is a gene not disclosed in either International Publication No. WO 2015/105657, International Publication No. WO 2016/196386, or both.

In another aspect, provided herein is a method for modulating the amount of an RNA transcript produced from a DNA sequence comprising a DNA nucleotide sequence encoding exons and one or more introns, comprising in 5' to 3' order: a branch point, a 3' splice site and a non-endogenous iREMS; wherein the iREMS comprises a DNA sequence GAgtrngn (SEQ ID NO: 4), wherein r is adenine or guanine and n is any nucleotide, the method comprising contacting the RNA transcript with a compound of Formula (I) or a form thereof, wherein Formula (I) is:

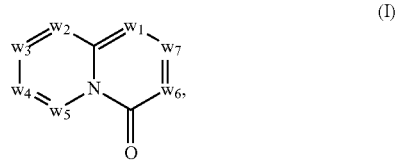

(I)

wherein:
$w_1$ and $w_5$ are independently C—$R_a$ or N;
$w_2$ is C—$R_b$ or N;
$w_3$, $w_4$ and $w_7$ are independently C—$R_1$, C—$R_2$, C—$R_a$ or N;
$w_6$ is C—$R_1$, C—$R_2$, C—$R_c$ or N;
wherein one of $w_3$, $w_4$, $w_6$ and $w_7$ is C—$R_1$ and one other of $w_3$, $w_4$, $w_6$ and $w_7$ is C—$R_2$, provided that,
when $w_3$ is C—$R_1$, then $w_6$ is C—$R_2$ and $w_4$ and $w_7$ are independently C—$R_a$ or N; or,
when $w_3$ is C—$R_2$, then $w_6$ is C—$R_1$ and $w_4$ and $w_7$ are independently C—$R_a$ or N; or,
when $w_4$ is C—$R_1$, then $w_7$ is C—$R_2$ and $w_3$ is C—$R_a$ or N and $w_6$ is C—$R_c$ or N; or,
when $w_4$ is C—$R_2$, then $w_7$ is C—$R_1$ and $w_3$ is C—$R_a$ or N and $w_6$ is C—$R_c$ or N; and,
wherein any one, two or three of $w_1$, $w_2$, $w_3$, $w_4$, $w_5$, $w_6$ and $w_7$ may optionally be N;
$R_1$ is $C_{1-8}$alkyl, amino, $C_{1-8}$alkyl-amino, $(C_{1-8}$alkyl$)_2$-amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl$)$amino, amino-$C_{1-8}$alkyl, $C_{1-8}$alkyl-amino-$C_{1-8}$alkyl, $(C_{1-8}$alkyl$)_2$-amino-$C_{1-8}$alkyl, $C_{1-8}$alkoxy-$C_{1-8}$alkyl-amino-$C_{1-8}$alkyl, $(C_{1-8}$alkoxy-$C_{1-8}$alkyl$)_2$-amino-$C_{1-8}$alkyl, $(C_{1-8}$alkoxy-$C_{1-8}$alkyl$)(C_{1-8}$alkyl$)$amino-$C_{1-8}$alkyl, amino-$C_{1-8}$alkyl-amino, (amino-$C_{1-8}$alkyl$)_2$-amino, (amino-$C_{1-8}$alkyl$)(C_{1-8}$alkyl$)$amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl-amino-$C_{1-8}$alkyl$)(C_{1-8}$alkyl$)$amino, $(C_{1-8}$alkyl$)_2$-amino-$C_{1-8}$alkyl-amino, $[(C_{1-8}$alkyl$)_2$-amino-$C_{1-8}$alkyl$](C_{1-8}$alkyl$)$amino, amino-$C_{1-8}$alkoxy, $C_{1-8}$alkyl-amino-$C_{1-8}$alkoxy, $(C_{1-8}$alkyl$)_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, $(C_{1-8}$alkoxy-$C_{1-8}$alkyl$)(C_{1-8}$alkyl$)$amino-$C_{1-8}$alkoxy, amino-$C_{2-8}$alkenyl, $C_{1-8}$alkyl-amino-$C_{2-8}$alkenyl, $(C_{1-8}$alkyl$)_2$-amino-$C_{2-8}$alkenyl, amino-$C_{2-8}$alkynyl, $C_{1-8}$alkyl-amino-$C_{2-8}$alkynyl, $(C_{1-8}$alkyl$)_2$-amino-$C_{2-8}$alkynyl, halo-$C_{1-8}$alkyl-amino, (halo-$C_{1-8}$alkyl$)_2$-amino, (halo-$C_{1-8}$alkyl$)(C_{1-8}$alkyl$)$amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino, (hydroxy-$C_{1-8}$alkyl$)(C_{1-8}$alkyl$)$amino, hydroxy-$C_{1-8}$alkyl-amino-$C_{1-8}$alkyl, (hydroxy-$C_{1-8}$alkyl$)_2$-amino-$C_{1-8}$alkyl, (hydroxy-$C_{1-8}$alkyl$)(C_{1-8}$alkyl$)$amino-$C_{1-8}$alkyl, hydroxy-$C_{1-8}$alkyl-amino-$C_{1-8}$alkoxy, (hydroxy-$C_{1-8}$alkyl$)_2$-amino-$C_{1-8}$alkoxy, (hydroxy-$C_{1-8}$alkyl$)(C_{1-8}$alkyl$)$amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl$)_2$-amino, (hydroxy-$C_{1-8}$alkyl$)_2$-amino-$C_{1-8}$alkyl-amino, (hydroxy-$C_{1-8}$alkyl-amino-$C_{1-8}$alkyl$)(C_{1-8}$alkyl$)$amino, (hydroxy-$C_{1-8}$alkyl$)(C_{1-8}$alkyl$)$amino-$C_{1-8}$alkyl-amino, [(hydroxy-$C_{1-8}$alkyl$)_2$-amino-$C_{1-8}$alkyl$](C_{1-8}$alkyl$)$amino, [(hydroxy-$C_{1-8}$alkyl$)(C_{1-8}$alkyl$)$amino-$C_{1-8}$alkyl$](C_{1-8}$alkyl$)$amino, heterocyclyl, heterocyclyl-$C_{1-8}$alkyl, heterocyclyl-$C_{1-8}$alkoxy, heterocyclyl-amino, (heterocyclyl)$(C_{1-8}$alkyl$)$amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl$)(C_{1-8}$alkyl$)$amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl$)(C_{1-8}$alkyl$)$amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl$)_2$-amino, (aryl-$C_{1-8}$alkyl$)(C_{1-8}$alkyl$)$amino, aryl-$C_{1-8}$alkyl-amino-$C_{1-8}$alkyl, (aryl-$C_{1-8}$alkyl$)_2$-amino-$C_{1-8}$alkyl, (aryl-$C_{1-8}$alkyl$)(C_{1-8}$alkyl$)$amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl$)(C_{1-8}$alkyl$)$amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl$)(C_{1-8}$alkyl$)$amino-$C_{1-8}$alkyl;
wherein, each instance of heterocyclyl, $C_{3-14}$cycloalkyl, aryl and heteroaryl is optionally substituted with one, two or three $R_3$ substituents and optionally, with one additional $R_4$ substituent; or,
wherein, each instance of heterocyclyl, $C_{3-14}$cycloalkyl, aryl and heteroaryl is optionally substituted with one, two, three or four $R_3$ substituents;

R₂ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)₂-amino, amino-$C_{1-8}$alkyl, $C_{1-8}$alkyl-amino-$C_{1-8}$alkyl, ($C_{1-8}$alkyl)₂-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)₂-amino, ($C_{1-8}$alkyl)₂-amino-$C_{1-8}$alkyl-amino, [($C_{1-8}$alkyl)₂-amino-$C_{1-8}$alkyl]₂-amino, ($C_{1-8}$alkyl-amino-$C_{1-8}$alkyl)($C_{1-8}$alkyl)amino, [($C_{1-8}$alkyl)₂-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)₂-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)₂-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)₂-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)₂-amino or $C_{1-8}$alkyl-thio; and, $R_7$ is $C_{3-14}$cycloalkyl, $C_{3-14}$cycloalkyl-oxy, aryl, heterocyclyl or heteroaryl.

In certain embodiments, the iREMS comprises a DNA sequence GAgtrngn (SEQ ID NO: 4), wherein r is adenine or guanine and n is any nucleotide. In certain embodiments, n is adenine or guanine. In certain embodiments, the iREMS comprises a DNA sequence NNGAgtrngn (SEQ ID NO: 3), wherein r is adenine or guanine and n or N is any nucleotide. In a specific embodiment, the DNA sequence NNGAgtrngn (SEQ ID NO: 3) is selected from the group consisting of ANGAgtrngn (SEQ ID NO: 1829), CNGAgtrngn (SEQ ID NO: 1835), GNGAgtrngn (SEQ ID NO: 1841), TNGAgtrngn (SEQ ID NO: 1847), NAGAgtrngn (SEQ ID NO: 1830), NCGAgtrngn (SEQ ID NO: 1836), NGGAgtrngn (SEQ ID NO: 1842), NTGAgtrngn (SEQ ID NO: 1848), AAGAgtrngn (SEQ ID NO: 1831), ACGAgtrngn (SEQ ID NO: 1837), AGGAgtrngn (SEQ ID NO: 1843), ATGAgtrngn (SEQ ID NO: 1849), CAGAgtrngn (SEQ ID NO: 1832), CCGAgtrngn (SEQ ID NO: 1838), CGGAgtrngn (SEQ ID NO: 1844), CTGAgtrngn (SEQ ID NO: 1850), GAGAgtrngn (SEQ ID NO: 1833), GCGAgtrngn (SEQ ID NO: 1839), GGGAgtrngn (SEQ ID NO: 1845), GTGAgtrngn (SEQ ID NO: 1851), TAGAgtrngn (SEQ ID NO: 1834), TCGAgtrngn (SEQ ID NO: 1840), TGGAgtrngn (SEQ ID NO: 1846) and TTGAgtrngn (SEQ ID NO: 1852). In certain embodiments, n is adenine or guanine.

In certain embodiments, the iREMS comprises a DNA sequence NNGAgtragt (SEQ ID NO: 3864), wherein r is adenine or guanine and N is any nucleotide. In a specific embodiment, the DNA sequence NNGAgtragt (SEQ ID NO: 3864) is selected from the group consisting of ANGAgtragt (SEQ ID NO: 2237), CNGAgtragt (SEQ ID NO: 2243), GNGAgtragt (SEQ ID NO: 2249), TNGAgtragt (SEQ ID NO: 2255), NAGAgtragt (SEQ ID NO: 2238), NCGAgtragt (SEQ ID NO: 2244), NGGAgtragt (SEQ ID NO: 2250), NTGAgtragt (SEQ ID NO: 2256), AAGAgtragt (SEQ ID NO: 2239), ACGAgtragt (SEQ ID NO: 2245), AGGAgtragt (SEQ ID NO: 2251), ATGAgtragt (SEQ ID NO: 2257), CAGAgtragt (SEQ ID NO: 2240), CCGAgtragt (SEQ ID NO: 2246), CGGAgtragt (SEQ ID NO: 2252), CTGAgtragt (SEQ ID NO: 2258), GAGAgtragt (SEQ ID NO: 2241), GCGAgtragt (SEQ ID NO: 2247), GGGAgtragt (SEQ ID NO: 2253), GTGAgtragt (SEQ ID NO: 2259), TAGAgtragt (SEQ ID NO: 2242), TCGAgtragt (SEQ ID NO: 2248), TGGAgtragt (SEQ ID NO: 2254) and TTGAgtragt (SEQ ID NO: 2260), wherein r is adenine or guanine, and N is any nucleotide. In a specific embodiment, the iREMS comprises a DNA sequence presented in Table 14. In certain embodiments, n is adenine or guanine. In certain embodiments of the aspects and embodiments described herein, n is adenine or guanine.

In certain embodiments of a method for modulating the amount of an RNA transcript described herein, modulation of the amount of the RNA transcript is modulation of the amount of the RNA transcript in a cell or a lysate of the cell, the method comprising contacting the compound of Formula (I) or a form thereof with the cell or the cell lysate. In a specific embodiment of a method for modulating the amount of an RNA transcript described herein, modulation of the amount of the RNA transcript is modulation of the amount of the RNA transcript in a cell, the method comprising contacting the compound of Formula (I) or a form thereof with the cell. In certain embodiments of a method of modulating the amount of an RNA transcript described herein, the modulation modulates the amount and/or type of a protein translated from the RNA transcript and produced in the cell or lysate of the cell.

In certain embodiments of a method for modulating the amount of an RNA transcript described herein, modulation of the amount of the RNA transcript is modulation of the amount of the RNA transcript in a subject, the method comprising administering the compound of Formula (I) or a form thereof to the subject. In certain embodiments of a method for modulating the amount of an RNA transcript described herein, the modulation modulates the amount and/or type of a protein translated from the RNA transcript and produced in the subject. In a specific embodiment, the subject is a non-human subject. In another specific embodiment, the subject is a human subject.

In certain embodiments, the RNA transcript encodes a detectable reporter protein.

In another aspect, provided herein is an artificial gene construct comprising an RNA sequence comprising exons and one or more introns, wherein at least one intron comprises an iREMS that is downstream of a branch point and a 3' splice site and wherein the iREMS comprises the sequence GAgurngn (SEQ ID NO: 2), wherein r is adenine or guanine and n is any nucleotide. In certain embodiments, n is adenine or guanine. In certain embodiments, one, two, or all of the iREMS, the branch point, and the 3' splice site are non-endogenous. In certain embodiments, one, two, or all of the iREMS, the branch point, and the 3' splice site are endogenous.

In another aspect, provided herein is an artificial gene construct comprising a DNA sequence encoding exons and one or more introns, wherein the nucleotide sequence encoding at least one intron comprises an iREMS that is downstream of the nucleotide sequence encoding a branch point and the nucleotide sequence encoding a 3' splice site, and wherein the iREMS comprises the sequence GAgtrngn (SEQ ID NO: 4), wherein r is adenine or guanine and n is any nucleotide. In certain embodiments, n is adenine or guanine. In certain embodiments, one, two, or all of the iREMS, the branch point, and the 3' splice site are non-endogenous. In certain embodiments, one, two, or all of the iREMS, the branch point, and the 3' splice site are endogenous.

In another aspect, provided herein is a cell comprising an RNA sequence comprising exons and one or more introns, wherein at least one intron comprises an iREMS that is downstream of a branch point and a 3' splice site and wherein the iREMS comprises the sequence GAgurngn (SEQ ID NO: 2), wherein r is adenine or guanine and n is any nucleotide. In certain embodiments, n is adenine or guanine. In certain embodiments, one, two, or all of the iREMS, the branch point, and the 3' splice site are non-endogenous. In certain embodiments, one, two, or all of the iREMS, the branch point, and the 3' splice site are endogenous.

In another aspect, provided herein is a cell comprising a DNA sequence encoding exons and one or more introns, wherein the nucleotide sequence encoding at least one intron comprises an iREMS that is downstream of the nucleotide sequence encoding a branch point and the nucleotide sequence encoding a 3' splice site, and wherein the iREMS comprises the sequence GAgtrngn (SEQ ID NO: 4), wherein r is adenine or guanine and n is any nucleotide. In certain embodiments, one, two, or all of the iREMS, the branch point, and the 3' splice site are non-endogenous. In certain embodiments, one, two, or all of the iREMS, the branch point, and the 3' splice site are endogenous.

In another aspect, provided herein is a cell comprising an artificial gene construct described herein.

In another aspect, provided herein is a cell comprising a vector comprising an artificial gene construct described herein.

In another aspect, provided herein is a method for modulating the amount of an RNA transcript comprising a RNA nucleotide sequence comprising in 5' to 3' order: a branch point, a 3' splice site, and an endogenous intronic recognition element for splicing modifier (iREMS), wherein the iREMS comprises an RNA sequence GAgurngn (SEQ ID NO: 2), wherein r is adenine or guanine and n is any nucleotide, and wherein the RNA transcript is an RNA transcript of a gene that is selected from ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA1, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837; the method comprising contacting the RNA transcript with a compound of Formula (I) or a form thereof, wherein Formula (I) is:

$$\text{(I)}$$

wherein:
$w_1$ and $w_5$ are independently C—$R_a$ or N;
$w_2$ is C—$R_b$ or N;
$w_3$, $w_4$ and $w_7$ are independently C—$R_1$, C—$R_2$, C—$R_a$ or N;
$w_6$ is C—$R_1$, C—$R_2$, C—$R_c$ or N;
wherein one of $w_3$, $w_4$, $w_6$ and $w_7$ is C—$R_1$ and one other of $w_3$, $w_4$, $w_6$ and $w_7$ is C—$R_2$, provided that,
when $w_3$ is C—$R_1$, then $w_6$ is C—$R_2$ and $w_4$ and $w_7$ are independently C—$R_a$ or N; or,
when $w_3$ is C—$R_2$, then $w_6$ is C—$R_1$ and $w_4$ and $w_7$ are independently C—$R_a$ or N; or,
when $w_4$ is C—$R_1$, then $w_7$ is C—$R_2$ and $w_3$ is C—$R_a$ or N and $w_6$ is C—$R_c$ or N; or,
when $w_4$ is C—$R_2$, then $w_7$ is C—$R_1$ and $w_3$ is C—$R_a$ or N and $w_6$ is C—$R_c$ or N; and,
wherein any one, two or three of $w_1$, $w_2$, $w_3$, $w_4$, $w_5$, $w_6$ and $w_7$ may optionally be N;
$R_1$ is $C_{1-8}$alkyl, amino, $C_{1-8}$alkyl-amino, $(C_{1-8}$alkyl$)_2$-amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl$)$amino, amino-$C_{1-8}$alkyl, $C_{1-8}$alkyl-amino-$C_{1-8}$alkyl, $(C_{1-8}$alkyl$)_2$-amino-$C_{1-8}$alkyl, $C_{1-8}$alkoxy-$C_{1-8}$alkyl-amino-$C_{1-8}$alkyl, $(C_{1-8}$alkoxy-$C_{1-8}$alkyl$)_2$-amino-$C_{1-8}$alkyl, $(C_{1-8}$alkoxy-$C_{1-8}$alkyl$)(C_{1-8}$alkyl$)$amino-$C_{1-8}$alkyl, amino-$C_{1-8}$alkyl-amino, (amino-$C_{1-8}$alkyl$)_2$-amino, (amino-$C_{1-8}$alkyl$)(C_{1-8}$alkyl$)$amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl-amino-$C_{1-8}$alkyl$)(C_{1-8}$alkyl$)$amino, $(C_{1-8}$alkyl$)_2$-amino-$C_{1-8}$alkyl-amino, $[(C_{1-8}$alkyl$)_2$-amino-$C_{1-8}$alkyl$](C_{1-8}$alkyl$)$amino, amino-$C_{1-8}$alkoxy, $C_{1-8}$alkyl-amino-$C_{1-8}$alkoxy, $(C_{1-8}$alkyl$)_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, $(C_{1-8}$alkoxy-$C_{1-8}$alkyl$)(C_{1-8}$alkyl$)$amino-$C_{1-8}$alkoxy, amino-$C_{2-8}$alkenyl, $C_{1-8}$alkyl-amino-$C_{2-8}$alkenyl, $(C_{1-8}$alkyl$)_2$-amino-$C_{2-8}$alkenyl, amino-$C_{2-8}$alkynyl, $C_{1-8}$alkyl-amino-$C_{2-8}$alkynyl, $(C_{1-8}$alkyl$)_2$-amino-$C_{2-8}$alkynyl, halo-$C_{1-8}$alkyl-amino, (halo-$C_{1-8}$alkyl$)_2$-amino, (halo-$C_{1-8}$alkyl$)(C_{1-8}$alkyl$)$amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino, (hydroxy-$C_{1-8}$alkyl$)(C_{1-8}$alkyl$)$amino, hydroxy-$C_{1-8}$alkyl-amino-$C_{1-8}$alkyl, (hydroxy-$C_{1-8}$alkyl$)_2$-amino-$C_{1-8}$alkyl, (hydroxy-$C_{1-8}$alkyl$)(C_{1-8}$alkyl$)$amino-$C_{1-8}$alkyl, hydroxy-$C_{1-8}$alkyl-amino-$C_{1-8}$alkoxy, (hydroxy-$C_{1-8}$alkyl$)_2$-amino-$C_{1-8}$alkoxy, (hydroxy-$C_{1-8}$alkyl$)(C_{1-8}$alkyl$)$amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl$)_2$-amino, (hydroxy-$C_{1-8}$alkyl$)_2$-amino-$C_{1-8}$alkyl-amino, (hydroxy-$C_{1-8}$alkyl-amino-$C_{1-8}$alkyl$)(C_{1-8}$alkyl$)$amino, (hydroxy-$C_{1-8}$alkyl$)(C_{1-8}$alkyl$)$amino-$C_{1-8}$alkyl-amino, [(hydroxy-$C_{1-8}$alkyl$)_2$-amino-$C_{1-8}$alkyl$](C_{1-8}$alkyl$)$amino, [(hydroxy-$C_{1-8}$alkyl$)(C_{1-8}$alkyl$)$amino-$C_{1-8}$alkyl$](C_{1-8}$alkyl$)$amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl$)(C_{1-8}$alkyl$)$amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl$)(C_{1-8}$alkyl$)$amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl$)_2$-amino, (aryl-$C_{1-8}$alkyl$)(C_{1-8}$alkyl$)$amino, aryl-$C_{1-8}$alkyl-amino-$C_{1-8}$alkyl, (aryl-$C_{1-8}$alkyl$)_2$-amino-$C_{1-8}$alkyl, (aryl-$C_{1-8}$alkyl$)(C_{1-8}$alkyl$)$amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl$)(C_{1-8}$alkyl$)$amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl$)(C_{1-8}$alkyl$)$amino-$C_{1-8}$alkyl;
wherein, each instance of heterocyclyl, $C_{3-14}$cycloalkyl, aryl and heteroaryl is optionally substituted with one, two or three $R_3$ substituents and optionally, with one additional $R_4$ substituent; or,
wherein, each instance of heterocyclyl, $C_{3-14}$cycloalkyl, aryl and heteroaryl is optionally substituted with one, two, three or four $R_3$ substituents;
$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;
$R_a$ is, in each instance, independently selected from hydrogen, halogen, $C_{1-8}$alkyl or deuterium;
$R_b$ is hydrogen, halogen, $C_{1-8}$alkyl, $C_{1-8}$alkoxy or deuterium;
$R_c$ is hydrogen, halogen, $C_{1-8}$alkyl or deuterium;
$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, $(C_{1-8}$alkyl$)_2$-amino, amino-$C_{1-8}$alkyl, $C_{1-8}$alkyl-amino-$C_{1-8}$alkyl, $(C_{1-8}$alkyl$)_2$-amino-$C_{1-8}$alkyl, amino-$C_{1-8}$alkyl-amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl$)_2$-amino-$C_{1-8}$alkyl-amino, $[(C_{1-8}$alkyl$)_2$-amino-$C_{1-8}$alkyl$]_2$-amino, $(C_{1-8}$alkyl-amino-$C_{1-8}$alkyl$)(C_{1-8}$alkyl$)$amino, $[(C_{1-8}$alkyl$)_2$-amino-$C_{1-8}$alkyl$](C_{1-8}$alkyl$)$amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl$)$amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino or (hydroxy-$C_{1-8}$alkyl$)(C_{1-8}$alkyl$)$amino;
$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;
$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, $(C_{1-8}$alkyl$)_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, $(C_{1-8}$alkyl$)_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In another aspect provided herein is a method for modulating the amount of an RNA transcript comprising a RNA nucleotide sequence comprising in 5' to 3' order: a branch point, a 3' splice site and an endogenous or non-endogenous intronic recognition element for splicing modifier (iREMS); wherein the iREMS comprises an RNA sequence GAgurngn (SEQ ID NO: 2), wherein r is adenine or guanine and n is any nucleotide, the method comprising contacting the RNA transcript with a compound of Formula (I) or a form thereof, wherein Formula (I) is:

$$(I)$$

wherein:

$w_1$ and $w_5$ are independently C—$R_a$ or N;

$w_2$ is C—$R_b$ or N;

$w_3$, $w_4$ and $w_7$ are independently C—$R_1$, C—$R_2$, C—$R_a$ or N;

$w_6$ is C—$R_1$, C—$R_2$, C—$R_c$ or N;

wherein one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N; and, wherein any one, two or three of $w_1$, $w_2$, $w_3$, $w_4$, $w_5$, $w_6$ and $w_7$ may optionally be N;

$R_1$ is $C_{1-8}$alkyl, amino, $C_{1-8}$alkyl-amino, $(C_{1-8}$alkyl$)_2$-amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl)amino, amino-$C_{1-8}$alkyl, $C_{1-8}$alkyl-amino-$C_{1-8}$alkyl, $(C_{1-8}$alkyl$)_2$-amino-$C_{1-8}$alkyl, $C_{1-8}$alkoxy-$C_{1-8}$alkyl-amino-$C_{1-8}$alkyl, $(C_{1-8}$alkoxy-$C_{1-8}$alkyl$)_2$-amino-$C_{1-8}$alkyl, $(C_{1-8}$alkoxy-$C_{1-8}$alkyl$)(C_{1-8}$alkyl)amino-$C_{1-8}$alkyl, amino-$C_{1-8}$alkyl-amino, (amino-$C_{1-8}$alkyl$)_2$-amino, (amino-$C_{1-8}$alkyl$)(C_{1-8}$alkyl)amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl-amino-$C_{1-8}$alkyl$)(C_{1-8}$alkyl)amino, $(C_{1-8}$alkyl$)_2$-amino-$C_{1-8}$alkyl-amino, [$(C_{1-8}$alkyl$)_2$-amino-$C_{1-8}$alkyl]$(C_{1-8}$alkyl)amino, amino-$C_{1-8}$alkoxy, $C_{1-8}$alkyl-amino-$C_{1-8}$alkoxy, $(C_{1-8}$alkyl$)_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, $(C_{1-8}$alkoxy-$C_{1-8}$alkyl$)(C_{1-8}$alkyl)amino-$C_{1-8}$alkoxy, amino-$C_{2-8}$alkenyl, $C_{1-8}$alkyl-amino-$C_{2-8}$alkenyl, $(C_{1-8}$alkyl$)_2$-amino-$C_{2-8}$alkenyl, amino-$C_{2-8}$alkynyl, $C_{1-8}$alkyl-amino-$C_{2-8}$alkynyl, $(C_{1-8}$alkyl$)_2$-amino-$C_{2-8}$alkynyl, halo-$C_{1-8}$alkyl-amino, (halo-$C_{1-8}$alkyl$)_2$-amino, (halo-$C_{1-8}$alkyl$)(C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino, (hydroxy-$C_{1-8}$alkyl$)(C_{1-8}$alkyl)amino, hydroxy-$C_{1-8}$alkyl-amino-$C_{1-8}$alkyl, (hydroxy-$C_{1-8}$alkyl$)_2$-amino-$C_{1-8}$alkyl, (hydroxy-$C_{1-8}$alkyl$)(C_{1-8}$alkyl)amino-$C_{1-8}$alkyl, hydroxy-$C_{1-8}$alkyl-amino-$C_{1-8}$alkoxy, (hydroxy-$C_{1-8}$alkyl$)_2$-amino-$C_{1-8}$alkoxy, (hydroxy-$C_{1-8}$alkyl$)(C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl$)_2$-amino, (hydroxy-$C_{1-8}$alkyl$)_2$-amino-$C_{1-8}$alkyl-amino, (hydroxy-$C_{1-8}$alkyl-amino-$C_{1-8}$alkyl)$(C_{1-8}$alkyl)amino, (hydroxy-$C_{1-8}$alkyl)$(C_{1-8}$alkyl)amino-$C_{1-8}$alkyl-amino, [(hydroxy-$C_{1-8}$alkyl$)_2$-amino-$C_{1-8}$alkyl]$(C_{1-8}$alkyl)amino, [(hydroxy-$C_{1-8}$alkyl)$(C_{1-8}$alkyl)amino-$C_{1-8}$alkyl]$(C_{1-8}$alkyl)amino, heterocyclyl, heterocyclyl-$C_{1-8}$alkyl, heterocyclyl-$C_{1-8}$alkoxy, heterocyclyl-amino, (heterocyclyl)$(C_{1-8}$alkyl)amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl)$(C_{1-8}$alkyl)amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl)$(C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl$)_2$-amino, (aryl-$C_{1-8}$alkyl)$(C_{1-8}$alkyl)amino, aryl-$C_{1-8}$alkyl-amino-$C_{1-8}$alkyl, (aryl-$C_{1-8}$alkyl$)_2$-amino-$C_{1-8}$alkyl, (aryl-$C_{1-8}$alkyl)$(C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl)$(C_{1-8}$alkyl)amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl)$(C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, $(C_{1-8}$alkyl$)_2$-amino, amino-$C_{1-8}$alkyl, $C_{1-8}$alkyl-amino-$C_{1-8}$alkyl, $(C_{1-8}$alkyl$)_2$-amino-$C_{1-8}$alkyl, amino-$C_{1-8}$alkyl-amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl$)_2$-amino-$C_{1-8}$alkyl-amino, [$(C_{1-8}$alkyl$)_2$-amino-$C_{1-8}$alkyl]$_2$-amino, $(C_{1-8}$alkyl-amino-$C_{1-8}$alkyl)$(C_{1-8}$alkyl)amino, [$(C_{1-8}$alkyl$)_2$-amino-$C_{1-8}$alkyl]$(C_{1-8}$alkyl)amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl)$(C_{1-8}$alkyl)amino, $C_{1-8}$alkyl-carbonyl-amino, $C_{1-8}$alkoxy-carbonyl-amino, hydroxy-$C_{1-8}$alkyl, hydroxy- $C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In certain embodiments, the RNA transcript is an RNA transcript of a gene that is selected from ABCB8, ABCC3, ADAM17, ADCY3, AGPAT4, ANKRA2, ANXA11, APIP, APLP2, APPL2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DAGLB, DCAF17, DCUN1D4, DDX42, DENND1A, DENND5A, DGKA, DHFR, DIAPH3, DLGAP4, DNAJC13, DNMBP, DOCK1, DYRK1A, EIF2B3, ENAH, ENOX1, EP300, ERC1, ERCC1, ERGIC3, ERLIN2, ERRFI1, EVC, FAF1, FAIM, FAM126A, FAM13A, FAM162A, FAM174A, FAM198B, FBN2, FER, FHOD3, FOCAD, GALC, GCFC2, GGACT, GGCT, GLCE, GOLGA4, GOLGB1, GPSM2, GULP1, GXYLT1, HAT1, HDX, HLTF, HMGA2, HNMT, HPS1, HSD17B12, HSD17B4, HTT, IFT57, INPP5K, IVD, KDM6A, KIAA1524, KIAA1715, LETM2, LOC400927, LRRC42, LUC7L3, LYRM1, MADD, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPHLN1, PPIP5K2, PPP1R26, PRPF31, PRSS23, PRUNE2, PSMA4, PXK, RAF1, RAP1A, RAPGEF1, RARS2, RBKS, RERE, RFWD2, RNFT1, RPA1, RPS10, RPS6KB2, SAMD4A, SAR1A, SCO1, SEC24A, SENP6, SERGEF, SGK3, SH3YL1, SKA2, SLC12A2, SLC25A17, SLC44A2, SMYD3, SNAP23, SNHG16, SNX7, SOS2, SPATA18, SPATA5, SPIDR, SPRYD7, SRGAP1, SRRM1, STAT1, STRN3, STXBP6, SUPT20H, TAF2, TASP1, TBC1D15, TCF12, TCF4, TIAM1, TJP2, TMC3, TMEM189-UBE2V1, TMEM214, TNRC6A, TNS3, TOE1, TRAF3, TRIM65, TSPAN2, TTC7B, TUBE1, TYW5, UBAP2L, UBE2V1, URGCP, VAV2, VPS29, WDR27, WDR37, WDR91, WNK1, XRN2, ZCCHC8, ZFP82, ZNF138, ZNF232, ZNF37BP or ZNF680.

In another aspect, provided herein is a method for modulating the amount of an RNA transcript comprising a RNA nucleotide sequence, wherein the RNA nucleotide sequence comprises two exons and an intron, wherein one exon is upstream of the intron and the other exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn (SEQ ID NO: 2), wherein r is adenine or guanine and n is any nucleotide, the method comprising contacting the RNA transcript with a compound of Formula (I) or a form thereof, wherein Formula (I) is:

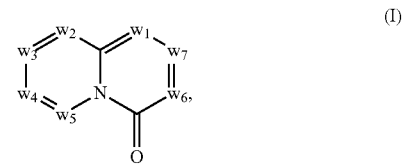

wherein:

$w_1$ and $w_5$ are independently C—$R_a$ or N;

$w_2$ is C—$R_b$ or N;

$w_3$, $w_4$ and $w_7$ are independently C—$R_1$, C—$R_2$, C—$R_a$ or N;

$w_6$ is C—$R_1$, C—$R_2$, C—$R_c$ or N;

wherein one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N; and, wherein any one, two or three of $w_1$, $w_2$, $w_3$, $w_4$, $w_5$, $w_6$ and $w_7$ may optionally be N;

$R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$ alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In another aspect, provided herein is a method for modulating the amount of an RNA transcript comprising a RNA nucleotide sequence, wherein the RNA nucleotide sequence comprises two exons and an intron, wherein one exon is upstream of the intron and the other exon is downstream of the intron, wherein the RNA nucleotide sequence of the intron comprises in 5' to 3' order: an iREMS, a first branch point and a first 3' splice site, wherein the iREMS comprises an RNA sequence GAgurngn (SEQ ID NO: 2), wherein r is adenine or guanine and n is any nucleotide, the method comprising contacting the RNA transcript with a compound of Formula (I) or a form thereof, wherein Formula (I) is:

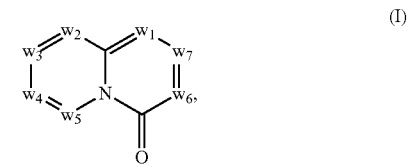

(I)

wherein:

$w_1$ and $w_5$ are independently C—$R_a$ or N;

$w_2$ is C—$R_b$ or N;

$w_3$, $w_4$ and $w_7$ are independently C—$R_1$, C—$R_2$, C—$R_a$ or N;

$w_6$ is C—$R_1$, C—$R_2$, C—$R_c$ or N;

wherein one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N; and, wherein any one, two or three of $w_1$, $w_2$, $w_3$, $w_4$, $w_5$, $w_6$ and $w_7$ may optionally be N;

$R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$- amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino; wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In certain embodiments, the iREMS is an endogenous iREMS, and the RNA transcript is an RNA transcript of a gene that is selected from ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837.

In certain embodiments, the iREMS is an endogenous iREMS, and the RNA transcript is an RNA transcript of a gene that is selected from ABCB8, ABCC3, ADAM17, ADCY3, AGPAT4, ANKRA2, ANXA11, APIP, APLP2, APPL2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DAGLB, DCAF17, DCUN1D4, DDX42, DENND1A, DENND5A, DGKA, DHFR, DIAPH3, DLGAP4, DNAJC13, DNMBP, DOCK1, DYRK1A, EIF2B3, ENAH, ENOX1, EP300, ERC1, ERCC1, ERGIC3, ERLIN2, ERRFI1, EVC, FAF1, FAIM, FAM126A, FAM13A, FAM162A, FAM174A, FAM198B, FBN2, FER, FHOD3, FOCAD, GALC, GCFC2, GGACT, GGCT, GLCE, GOLGA4, GOLGB1, GPSM2, GULP1, GXYLT1, HAT1, HDX, HLTF, HMGA2, HNMT, HPS1, HSD17B12, HSD17B4, HTT, IFT57, INPP5K, IVD, KDM6A, KIAA1524, KIAA1715, LETM2, LOC400927, LRRC42, LUC7L3, LYRM1, MADD, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPHLN1, PPIP5K2, PPP1R26, PRPF31, PRSS23, PRUNE2, PSMA4, PXK, RAF1, RAP1A, RAPGEF1, RARS2, RBKS, RERE, RFWD2, RNFT1, RPA1, RPS10, RPS6KB2, SAMD4A, SAR1A, SCO1, SEC24A, SENP6, SERGEF, SGK3, SH3YL1, SKA2, SLC12A2, SLC25A17, SLC44A2, SMYD3, SNAP23, SNHG16, SNX7, SOS2, SPATA18, SPATA5, SPIDR, SPRYD7, SRGAP1, SRRM1, STAT1, STRN3, STXBP6, SUPT20H, TAF2, TASP1, TBC1D15, TCF12, TCF4, TIAM1, TJP2, TMC3, TMEM189-UBE2V1, TMEM214, TNRC6A, TNS3, TOE1, TRAF3, TRIM65, TSPAN2, TTC7B, TUBE1, TYW5, UBAP2L, UBE2V1, URGCP, VAV2, VPS29, WDR27, WDR37, WDR91, WNK1, XRN2, ZCCHC8, ZFP82, ZNF138, ZNF232, ZNF37BP or ZNF680.

In certain embodiments, the iREMS is a non-endogenous iREMS. In a specific embodiment, the iREMS is a non-endogenous iREMS and the RNA transcript is an RNA transcript of a gene that is selected from ABCB8, ABCC3, ADAM17, ADCY3, AGPAT4, ANKRA2, ANXA11, APIP, APLP2, APPL2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DAGLB, DCAF17, DCUN1D4, DDX42, DENND1A, DENND5A, DGKA, DHFR, DIAPH3, DLGAP4, DNAJC13, DNMBP, DOCK1, DYRK1A, EIF2B3, ENAH, ENOX1, EP300, ERC1, ERCC1, ERGIC3, ERLIN2, ERRFI1, EVC, FAF1, FAIM, FAM126A, FAM13A, FAM162A, FAM174A, FAM198B, FBN2, FER, FHOD3, FOCAD, GALC, GCFC2, GGACT, GGCT, GLCE, GOLGA4, GOLGB1, GPSM2, GULP1, GXYLT1, HAT1, HDX, HLTF, HMGA2, HNMT, HPS1, HSD17B12, HSD17B4, HTT, IFT57, INPP5K, IVD, KDM6A, KIAA1524, KIAA1715, LETM2, LOC400927, LRRC42, LUC7L3, LYRM1, MADD, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPHLN1, PPIP5K2, PPP1R26, PRPF31, PRSS23, PRUNE2, PSMA4, PXK, RAF1, RAP1A, RAPGEF1, RARS2, RBKS, RERE, RFWD2, RNFT1, RPA1, RPS10, RPS6KB2, SAMD4A, SAR1A, SCO1, SEC24A, SENP6, SERGEF, SGK3, SH3YL1, SKA2, SLC12A2, SLC25A17, SLC44A2, SMYD3, SNAP23, SNHG16, SNX7, SOS2, SPATA18, SPATA5, SPIDR, SPRYD7, SRGAP1, SRRM1, STAT1, STRN3, STXBP6, SUPT20H, TAF2, TASP1, TBC1D15, TCF12, TCF4, TIAM1, TJP2, TMC3, TMEM189-UBE2V1, TMEM214, TNRC6A, TNS3, TOE1, TRAF3, TRIM65, TSPAN2, TTC7B, TUBE1, TYW5, UBAP2L, UBE2V1, URGCP, VAV2, VPS29, WDR27, WDR37, WDR91, WNK1, XRN2, ZCCHC8, ZFP82, ZNF138, ZNF232, ZNF37BP or ZNF680.

In one aspect, provided herein is a method for producing a mature mRNA transcript comprising iExon from a pre-mRNA transcript, wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide. In one embodiment, provided herein is a method for producing a mature mRNA transcript comprising an iExon, the method comprising contacting a pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide. In another embodiment, provided herein is a method for producing a mature mRNA transcript comprising an iExon, the method comprising contacting a cell or cell lysate containing a pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous or non-endogeous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide. In some embodiments, the pre-mRNA transcript is encoded by a gene disclosed herein (e.g., in a table herein).

In a particular embodiment, provided herein is a method for producing a mature mRNA transcript comprising an iExon, the method comprising contacting a pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide, wherein the pre-mRNA transcript is a pre-mRNA transcript of a gene that is selected from ABCB8, ABCC3, ADAM17, ADCY3, AGPAT4, ANKRA2, ANXA11, APIP, APPL2, ARHGAP1, ARL15, ASAP1, ASPH, ATAD2B, ATXN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, ENOX1, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPA1, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 or ZNF37BP. In another particular embodiment, provided herein is a method for producing a mature mRNA transcript comprising an iExon, the method comprising contacting a cell or cell lysate containing a pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide, wherein the pre-mRNA transcript is a pre-mRNA transcript of a gene that is selected from ABCB8, ABCC3, ADAM17, ADCY3, AGPAT4, ANKRA2, ANXA11, APIP, APPL2, ARHGAP1, ARL15, ASAP1, ASPH, ATAD2B, ATXN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, ENOX1, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPA1, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 or ZNF37BP.

In another aspect, provided herein is a method modulating the amount of a mature mRNA transcript produced by a pre-mRNA transcript, wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous or non-endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide. In one embodiment, provided herein is a method for modulating the amount of a mature mRNA transcript produced by a pre-mRNA transcript, the method comprising contacting the pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous or non-endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide. In another embodiment, provided herein is a method for modulating the amount of a mature mRNA transcript produced by a pre-mRNA transcript, the method comprising contacting a cell or cell lysate containing the pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous or non-endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide. In some embodiments, the intron further comprises a first 5' splice site, a second branch point, and a second 3' splice site upstream of the iREMS. In some embodiments, the pre-mRNA transcript is encoded by a gene disclosed herein (e.g., in a table herein).

In a particular embodiment, provided herein is a method for modulating the amount of a mature mRNA transcript produced by a pre-mRNA transcript, the method comprising contacting the pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide, and wherein the pre-mRNA transcript is a pre-mRNA transcript of a gene that is selected from ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DENB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837. In a particular embodiment, provided herein is a method for modulating the amount of a mature mRNA transcript produced by a pre-mRNA transcript, the method comprising contacting a cell or cell lysate containing the pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide, and wherein the pre-mRNA transcript is a pre-mRNA transcript of a gene that is selected from ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837. In some embodiments, the intron further comprises a first 5' splice site, a second branch point, and a second 3' splice site upstream of the iREMS.

In one aspect, provided herein is a method for preventing, treating or preventing and treating a disease or disorder in which a change in the level of expression of one, two, three or more RNA isoforms encoded by a gene is beneficial to the prevention and/or treatment of the disease, the method comprising administering a compound described herein to a subject in need thereof, wherein the one, two, three or more RNA isoforms are produced from a pre-mRNA transcript comprising two exons and an intron, wherein one exon is upstream of the intron and the other exon is downstream of the intron, wherein the intron comprises in 5' to 3' order: a first 5' splice site, a first branch point, a first 3' splice site, an endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide.

In one aspect, provided herein is a method for preventing, treating or preventing and treating a disease or disorder in which a change in the level of expression of one, two, three or more RNA isoforms encoded by a gene is beneficial to the prevention and/or treatment of the disease, the method comprising administering a compound described herein to a subject in need thereof, wherein the one, two, three or more RNA isoforms are produced from a pre-mRNA transcript comprising two exons and an intron, wherein one exon is upstream of the intron and the other exon is downstream of the intron, wherein the intron comprises in 5' to 3' order: an endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide.

In another aspect, provided herein is an artificial gene construct comprising an RNA sequence comprising exons and one or more introns, wherein at least one intron comprises an iREMS that is downstream of a branch point and a 3' splice site, and wherein the iREMS comprises the sequence GAgurngn (SEQ ID NO: 2), wherein r is adenine or guanine and n is any nucleotide.

In another aspect, provided herein is an artificial gene construct comprising an RNA sequence comprising two exons and an intron, wherein one exon is upstream of the intron and the other exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn (SEQ ID NO: 2), wherein r is adenine or guanine and n is any nucleotide.

In another aspect, provide herein is an artificial gene construct comprising an RNA sequence comprising two exons and an intron, wherein one exon is upstream of the intron and the other exon is downstream of the intron, wherein the RNA nucleotide sequence of the intron comprises in 5' to 3' order: an iREMS, a first branch point and a first 3' splice site, wherein the iREMS comprises an RNA sequence GAgurngn (SEQ ID NO: 2), wherein r is adenine or guanine and n is any nucleotide.

In various embodiments of the aspects and embodiments described herein, the iREMS comprises an RNA sequence GAguragu, wherein r is adenine or guanine.

In various embodiments of the aspects and embodiments described herein, the iREMS comprises an RNA sequence NNGAgurngn (SEQ ID NO: 1), wherein r is adenine or guanine and n or N is any nucleotide. In a specific embodiment, the RNA sequence NNGAgurngn (SEQ ID NO: 1) is selected from the group consisting of ANGAgurngn (SEQ ID NO: 29), CNGAgurngn (SEQ ID NO: 35), GNGAgurngn (SEQ ID NO: 41), UNGAgurngn (SEQ ID NO: 47), NAGAgurngn (SEQ ID NO: 30), NCGAgurngn (SEQ ID NO: 36), NGGAgurngn (SEQ ID NO: 42), NUGAgurngn (SEQ ID NO: 48), AAGAgurngn (SEQ ID NO: 31), ACGAgurngn (SEQ ID NO: 37), AGGAgurngn (SEQ ID NO: 43), AUGAgurngn (SEQ ID NO: 49), CAGAgurngn (SEQ ID NO: 32), CCGAgurngn (SEQ ID NO: 38), CGGAgurngn (SEQ ID NO: 44), CUGAgurngn (SEQ ID NO: 50), GAGAgurngn (SEQ ID NO: 33), GCGAgurngn (SEQ ID NO: 39), GGGAgurngn (SEQ ID NO: 45), GUGAgurngn (SEQ ID NO: 51), UAGAgurngn (SEQ ID NO: 34), UCGAgurngn (SEQ ID NO: 40), UGGAgurngn (SEQ ID NO: 46) and UUGAgurngn (SEQ ID NO: 52), wherein r is adenine or guanine and n or N is any nucleotide.

In various embodiments of the aspects and embodiments described herein, the iREMS comprises an RNA sequence NNGAguragu (SEQ ID NO: 3862), wherein r is adenine or guanine and N is any nucleotide. In a specific embodiment, the RNA sequence NNGAguragu (SEQ ID NO: 3862) is selected from the group consisting of ANGAguragu (SEQ ID NO: 437), CNGAguragu (SEQ ID NO: 443), GNGAguragu (SEQ ID NO: 449), UNGAguragu (SEQ ID NO: 455), NAGAguragu (SEQ ID NO: 438), NCGAguragu (SEQ ID NO: 444), NGGAguragu (SEQ ID NO: 450), NUGAguragu (SEQ ID NO: 456), AAGAguragu (SEQ ID NO: 439), ACGAguragu (SEQ ID NO: 445), AGGAguragu (SEQ ID NO: 451), AUGAguragu (SEQ ID NO: 457), CAGAguragu (SEQ ID NO: 440), CCGAguragu (SEQ ID NO: 446), CGGAguragu (SEQ ID NO: 452), CUGAguragu (SEQ ID NO: 458), GAGAguragu (SEQ ID NO: 441), GCGAguragu (SEQ ID NO: 447), GGGAguragu (SEQ ID NO: 453), GUGAguragu (SEQ ID NO: 459), UAGAguragu (SEQ ID NO: 442), UCGAguragu (SEQ ID NO: 448), UGGAguragu (SEQ ID NO: 454) and UUGAguragu (SEQ ID NO: 460), wherein r is adenine or guanine, and N is any nucleotide.

In various embodiments of the method for modulating the amount of an RNA transcript described herein, modulation of the amount of the RNA transcript is modulation of the amount of the RNA transcript in a cell or a lysate of the cell, and the method comprises contacting the compound of Formula (I) or a form thereof with the cell or cell lysate. In a specific embodiment, modulation of the amount of the RNA transcript is modulation of the amount of the RNA transcript in a cell, and the method comprises contacting the compound of Formula (I) or a form thereof with the cell. In a specific embodiment, the modulation modulates the amount and/or type of a protein translated from the RNA transcript and produced in the cell or lysate of the cell.

In various embodiments of the method for modulating the amount of an RNA transcript described herein, the RNA transcript encodes a detectable reporter protein.

In another aspect, provided herein is an artificial gene construct comprising a DNA sequence encoding exons and one or more introns, wherein the nucleotide sequence encoding at least one intron comprises an iREMS that is downstream of the nucleotide sequence encoding a branch point and the nucleotide sequence encoding a 3' splice site, and wherein the iREMS comprises the sequence GAgtrngn (SEQ ID NO: 4), wherein r is adenine or guanine and n is any nucleotide.

In another aspect, provided herein is an artificial gene construct comprising a DNA sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the nucleotide sequence encoding the intron comprises in 5' to 3' order: the nucleotide sequence encoding a first 5' splice site, the nucleotide sequence encoding a first branch point, the nucleotide sequence encoding a first 3' splice site, an iREMS, the nucleotide sequence encoding a second branch point and the nucleotide sequence encoding a second 3' splice site, wherein the iREMS comprises a DNA sequence GAgtrngn (SEQ ID NO: 4), wherein r is adenine or guanine and n is any nucleotide.

In another aspect, provide herein is an artificial gene construct comprising a DNA sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the nucleotide sequence encoding the intron comprises in 5' to 3' order: an iREMS, the nucleotide sequence encoding a first branch point and the nucleotide sequence encoding a first 3' splice site, wherein the iREMS comprises an DNA sequence GAgtrngn (SEQ ID NO: 4), wherein r is adenine or guanine and n is any nucleotide.

In various embodiments of the aspects and embodiments described herein, the iREMS comprises a DNA sequence GAgtragt, wherein r is adenine or guanine.

In various embodiments of the aspects and embodiments described herein, the iREMS comprises a DNA sequence NNGAgtrngn (SEQ ID NO: 1), wherein r is adenine or guanine and n or N is any nucleotide. In a specific embodiment, the DNA sequence NNGAgtrngn (SEQ ID NO: 1) is selected from the group consisting of ANGAgtrngn (SEQ ID NO: 29), CNGAgtrngn (SEQ ID NO: 35), GNGAgtrngn (SEQ ID NO: 41), TNGAgtrngn (SEQ ID NO: 47), NAGAgtrngn (SEQ ID NO: 30), NCGAgtrngn (SEQ ID NO: 36), NGGAgtrngn (SEQ ID NO: 42), NTGAgtrngn (SEQ ID NO: 48), AAGAgtrngn (SEQ ID NO: 31), ACGAgtrngn (SEQ ID NO: 37), AGGAgtrngn (SEQ ID NO: 43), ATGAgtrngn (SEQ ID NO: 49), CAGAgtrngn (SEQ ID NO: 32), CCGAgtrngn (SEQ ID NO: 38), CGGAgtrngn (SEQ ID NO: 44), CTGAgtrngn (SEQ ID NO: 50), GAGAgtrngn (SEQ ID NO: 33), GCGAgtrngn (SEQ ID NO: 39), GGGAgtrngn (SEQ ID NO: 45), GTGAgtrngn (SEQ ID NO: 51), TAGAgtrngn (SEQ ID NO: 34), TCGAgtrngn (SEQ ID NO: 40), TGGAgtrngn (SEQ ID NO: 46) and TTGAgtrngn (SEQ ID NO: 52), wherein r is adenine or guanine and n or N is any nucleotide.

In various embodiments of the aspects and embodiments described herein, the iREMS comprises a DNA sequence NNGAgtragt (SEQ ID NO: 3862), wherein r is adenine or guanine and N is any nucleotide. In a specific embodiment, the DNA sequence NNGAgtragt (SEQ ID NO: 3862) is selected from the group consisting of ANGAgtragt (SEQ ID NO: 437), CNGAgtragt (SEQ ID NO: 443), GNGAgtragt (SEQ ID NO: 449), TNGAgtragt (SEQ ID NO: 455), NAGAgtragt (SEQ ID NO: 438), NCGAgtragt (SEQ ID NO: 444), NGGAgtragt (SEQ ID NO: 450), NTGAgtragt (SEQ ID NO: 456), AAGAgtragt (SEQ ID NO: 439), ACGAgtragt (SEQ ID NO: 445), AGGAgtragt (SEQ ID NO: 451), ATGAgtragt (SEQ ID NO: 457), CAGAgtragt (SEQ ID NO: 440), CCGAgtragt (SEQ ID NO: 446), CGGAgtragt (SEQ ID NO: 452), CTGAgtragt (SEQ ID NO: 458), GAGAgtragt (SEQ ID NO: 441), GCGAgtragt (SEQ ID NO: 447), GGGAgtragt (SEQ ID NO: 453), GTGAgtragt (SEQ ID NO: 459), TAGAgtragt (SEQ ID NO: 442), TCGAgtragt (SEQ ID NO: 448), TGGAgtragt (SEQ ID NO: 454) and TTGAgtragt (SEQ ID NO: 460), wherein r is adenine or guanine, and N is any nucleotide.

BRIEF DESCRIPTION OF THE DRAWINGS

FIG. 6B illustrates the production of exon isoforms with control (DMSO). FIG. 6C illustrates the production of certain intronic Exon isoforms for ELMO2 in the presence of a compound described herein, each of which represent aspects of the interactions of an intronic REMS, one or more branch points, one or more 3' splice sites and compounds as described herein.

DETAILED DESCRIPTION

Figure 1A:
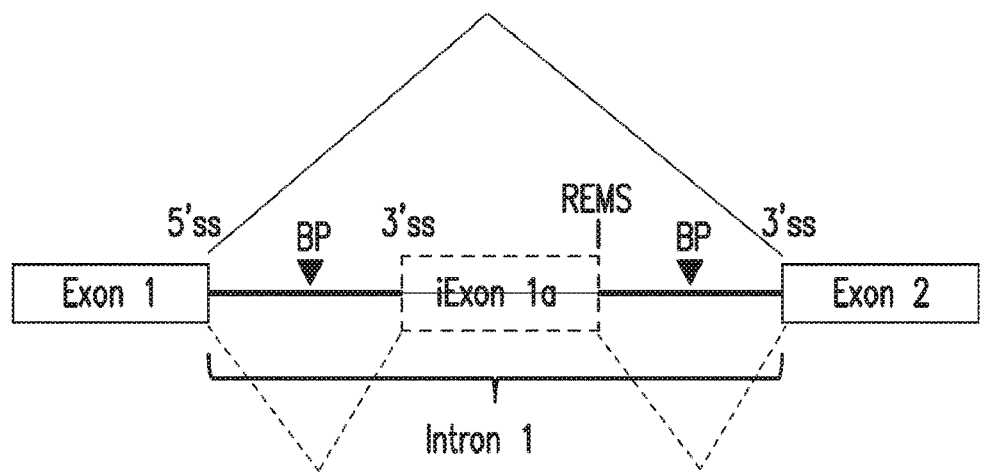
FIGS. 1A-1C. Representative schematics of intronic exon splicing mediated by an intronic REMS, where 5'ss represents a 5' splice site, 3'ss represents a 3' splice site and BP represents a splicing branch point. Exon 1e and Exon 2e represent extended exons. iExon 1a represents an intronic exon. Splicing events mediated by an intronic REMS in the absence of a compound described herein are illustrated by solid lines, splicing events mediated by an intronic REMS in the presence of a compound described herein are illustrated by dashed lines.

Intronic Recognition Element for Splicing Modifier (REMS)

In one aspect, provided herein is an intronic recognition element for splicing modifier (otherwise referred to as "iREMS") recognized by a small molecule splicing modifier, whereby elements of the associated iREMS complex affect interactions with the spliceosome as further described herein. In a specific embodiment, the intronic REMS has the nucleotide sequence GAgurngn (SEQ ID NO: 2) at the RNA level, wherein r is A or G (i.e., a purine nucleotide adenine or guanine) and n is any nucleotide. In another specific embodiment, the intronic REMS has the nucleotide sequence GAguragu (SEQ ID NO: 3866) at the RNA level, wherein r is adenine or guanine. In one or more of such specific embodiments provided herein, n is adenine or guanine. In a more specific embodiment, the intronic REMS has the nucleotide sequence NNGAgurngn (SEQ ID NO: 1) at the RNA level, wherein r is A or G (i.e., a purine nucleotide adenine or guanine) and n or N is any nucleotide. In another more specific embodiment, the intronic REMS has the nucleotide sequence NNGAguragu (SEQ ID NO: 3862) at the RNA level, wherein r is adenine or guanine and N is any nucleotide. In one or more of such more specific embodiments provided herein, N is adenine or guanine.

In another specific embodiment, the intronic REMS is downstream of an intronic branch point and a functional intronic 3' splice site, wherein the intronic REMS comprises a nucleotide sequence selected from the group consisting of ANGAgurngn (SEQ ID NO: 29), CNGAgurngn (SEQ ID NO: 35), GNGAgurngn (SEQ ID NO: 41), UNGAgurngn (SEQ ID NO: 47), NAGAgurngn (SEQ ID NO: 30), NCGAgurngn (SEQ ID NO: 36), NGGAgurngn (SEQ ID NO: 42), NUGAgurngn (SEQ ID NO: 48), AAGAgurngn (SEQ ID NO: 31), ACGAgurngn (SEQ ID NO: 37), AGGAgurngn (SEQ ID NO: 43), AUGAgurngn (SEQ ID NO: 49), CAGAgurngn (SEQ ID NO: 32), CCGAgurngn (SEQ ID NO: 38), CGGAgurngn (SEQ ID NO: 44), CUGAgurngn (SEQ ID NO: 50), GAGAgurngn (SEQ ID NO: 33), GCGAgurngn (SEQ ID NO: 39), GGGAgurngn (SEQ ID NO: 45), GUGAgurngn (SEQ ID NO: 51), UAGAgurngn (SEQ ID NO: 34), UCGAgurngn (SEQ ID NO: 40), UGGAgurngn (SEQ ID NO: 46) and UUGAgurngn (SEQ ID NO: 52) at the RNA level, wherein r is A or G (i.e., a purine nucleotide adenine or guanine) and n or N is any nucleotide, by which the intronic REMS, in the presence of a compound described herein, functions as an intronic 5' splice site, causing the NNGA (SEQ ID NO: 3863) nucleotides of the REMS and the intronic nucleotide sequence between the intronic 3' splice site down to and including the NNGA (SEQ ID NO: 3863) nucleotides to be spliced into the mature RNA as an intronic exon to provide a non-wild-type, nonfunctional mRNA.

In a preferred embodiment, the REMS has a nucleotide sequence selected from the group consisting of ANGAguragu (SEQ ID NO: 437), CNGAguragu (SEQ ID NO: 443), GNGAguragu (SEQ ID NO: 449), UNGAguragu (SEQ ID NO: 455), NAGAguragu (SEQ ID NO: 438), NCGAguragu (SEQ ID NO: 444), NGGAguragu (SEQ ID NO: 450), NUGAguragu (SEQ ID NO: 456), AAGAguragu (SEQ ID NO: 439), ACGAguragu (SEQ ID NO: 445), AGGAguragu (SEQ ID NO: 451), AUGAguragu (SEQ ID NO: 457), CAGAguragu (SEQ ID NO: 440), CCGAguragu (SEQ ID NO: 446), CGGAguragu (SEQ ID NO: 452), CUGAguragu (SEQ ID NO: 458), GAGAguragu (SEQ ID NO: 441), GCGAguragu (SEQ ID NO: 447), GGGAguragu (SEQ ID NO: 453), GUGAguragu (SEQ ID NO: 459), UAGAguragu (SEQ ID NO: 442), UCGAguragu (SEQ ID NO: 448), UGGAguragu (SEQ ID NO: 454) and UUGAguragu (SEQ ID NO: 460) at the RNA level, wherein r is A or G (i.e., a purine nucleotide adenine or guanine) and N is any nucleotide. In one or more embodiments provided herein, N is A or G.

In the context of DNA, in a specific embodiment, the nucleotide sequence encoding an intronic REMS has the sequence GAgtrngn (SEQ ID NO: 4), wherein r is A or G (i.e., a purine nucleotide adenine or guanine) and n is any nucleotide. In another specific embodiment, in the context of DNA, the nucleotide sequence encoding an intronic REMS has the sequence GAgtragt (SEQ ID NO: 3865), wherein r is A or G. In a specific embodiment, in the context of DNA, the nucleotide sequence encoding an intronic REMS has the sequence NNGAgtrngn (SEQ ID NO: 3), wherein r is A or G (i.e., a purine nucleotide adenine or guanine) and n or N is any nucleotide. In another specific embodiment, in the context of DNA, the nucleotide sequence encoding an intronic REMS has the sequence NNGAgtragt (SEQ ID NO: 3864), wherein r is A or G and N is any nucleotide.

In a specific embodiment, in the context of DNA, the nucleotide sequence encoding an intronic REMS comprises a sequence selected from the group consisting of ANGAgtrngn (SEQ ID NO: 1829), CNGAgtrngn (SEQ ID NO: 1835), GNGAgtrngn (SEQ ID NO: 1841), TNGAgtrngn (SEQ ID NO: 1847), NAGAgtrngn (SEQ ID NO: 1830), NCGAgtrngn (SEQ ID NO: 1836), NGGAgtrngn (SEQ ID NO: 1842), NTGAgtrngn (SEQ ID NO: 1848), AAGAgtrngn (SEQ ID NO: 1831), ACGAgtrngn (SEQ ID NO: 1837), AGGAgtrngn (SEQ ID NO: 1843), ATGAgtrngn (SEQ ID NO: 1849), CAGAgtrngn (SEQ ID NO: 1832), CCGAgtrngn (SEQ ID NO: 1838), CGGAgtrngn (SEQ ID NO: 1844), CTGAgtrngn (SEQ ID NO: 1850), GAGAgtrngn (SEQ ID NO: 1833), GCGAgtrngn (SEQ ID NO: 1839), GGGAgtrngn (SEQ ID NO: 1845), GTGAgtrngn (SEQ ID NO: 1851), TAGAgtrngn (SEQ ID NO: 1834), TCGAgtrngn (SEQ ID NO: 1840), TGGAgtrngn (SEQ ID NO: 1846) and TTGAgtrngn (SEQ ID NO: 1852), wherein r is A or G (i.e., a purine nucleotide adenine or guanine) and n or N is any nucleotide.

In a preferred embodiment, in the context of DNA, the nucleotide sequence encoding the intronic REMS comprises a sequence selected from the group consisting of ANGAgtragt (SEQ ID NO: 2237), CNGAgtragt (SEQ ID NO: 2243), GNGAgtragt (SEQ ID NO: 2249), TNGAgtragt (SEQ ID NO: 2255), NAGAgtragt (SEQ ID NO: 2238), NCGAgtragt (SEQ ID NO: 2244), NGGAgtragt (SEQ ID NO: 2250), NTGAgtragt (SEQ ID NO: 2256), AAGAgtragt (SEQ ID NO: 2239), ACGAgtragt (SEQ ID NO: 2245), AGGAgtragt (SEQ ID NO: 2251), ATGAgtragt (SEQ ID NO: 2257), CAGAgtragt (SEQ ID NO: 2240), CCGAgtragt (SEQ ID NO: 2246), CGGAgtragt (SEQ ID NO: 2252), CTGAgtragt (SEQ ID NO: 2258), GAGAgtragt (SEQ ID NO: 2241), GCGAgtragt (SEQ ID NO: 2247), GGGAgtragt (SEQ ID NO: 2253), GTGAgtragt (SEQ ID NO: 2259), TAGAgtragt (SEQ ID NO: 2242), TCGAgtragt (SEQ ID NO: 2248), TGGAgtragt (SEQ ID NO: 2254) and TTGAgtragt (SEQ ID NO: 2260), wherein r is A or G and N is any nucleotide. In one or more embodiments provided herein, N is A or G.

An intronic REMS can be part of an endogenous RNA or can be introduced into an RNA sequence that does not naturally contain the intronic REMS sequence (in which case, the introduced intronic REMS is a non-endogenous intronic REMS, i.e., an intronic REMS not naturally present in the corresponding RNA. A nucleotide sequence encoding an intronic REMS can also be part of an endogenous DNA sequence, or a nucleotide sequence encoding the intronic REMS can be introduced into a DNA sequence that does not naturally contain the nucleotide sequence encoding an intronic REMS.

In a specific embodiment, the intronic REMS is located in an intron which further comprises is downstream of a branch point and a functional 3' splice site which, in the presence of a small molecule splicing modifier, enables the REMS to function as a 5' splice site. In a specific embodiment, the intronic REMS is located in an intron and is downstream of a branch point and a functional 3' splice site which, in the presence of a small molecule splicing modifier, enables the REMS to function as a 5' splice site. Without being bound by any theory or mechanism, the small molecule compounds described herein have been shown to increase the affinity of the interaction between the U1 snRNP, as well as other components of the pre-mRNA splicing machinery, and the nucleotides NNGA (SEQ ID NO: 3863) of the REMS whereby, in the presence of the compound, the intronic REMS functions as a U1 snRNP binding site, causing the intronic nucleotides to be spliced as an intronic exon.

Compounds

Provided herein are compounds of Formula (I) for use in the methods described herein:

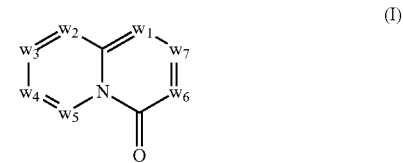

or a form thereof, wherein:
$w_1$ and $w_5$ are independently C—$R_a$ or N;
$w_2$ is C—$R_b$ or N;
$w_3$, $w_4$ and $w_7$ are independently C—$R_1$, C—$R_2$, C—$R_a$ or N;
$w_6$ is C—$R_1$, C—$R_2$, C—$R_c$ or N;
wherein one of $w_3$, $w_4$, $w_6$ and $w_7$ is C—$R_1$ and one other of $w_3$, $w_4$, $w_6$ and $w_7$ is C—$R_2$, provided that,
when $w_3$ is C—$R_1$, then $w_6$ is C—$R_2$ and $w_4$ and $w_7$ are independently C—$R_a$ or N; or,
when $w_3$ is C—$R_2$, then $w_6$ is C—$R_1$ and $w_4$ and $w_7$ are independently C—$R_a$ or N; or,
when $w_4$ is C—$R_1$, then $w_7$ is C—$R_2$ and $w_3$ is C—$R_a$ or N and $w_6$ is C—$R_c$ or N; or,
when $w_4$ is C—$R_2$, then $w_7$ is C—$R_1$ and $w_3$ is C—$R_a$ or N and $w_6$ is C—$R_c$ or N; and,
wherein any one, two or three of $w_1$, $w_2$, $w_3$, $w_4$, $w_5$, $w_6$ and $w_7$ may optionally be N;
$R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino,

[($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, each instance of heterocyclyl, $C_{3-14}$cycloalkyl, aryl and heteroaryl is optionally substituted with one, two or three $R_3$ substituents and optionally, with one additional $R_4$ substituent; or, wherein, each instance of heterocyclyl, $C_{3-14}$cycloalkyl, aryl and heteroaryl is optionally substituted with one, two, three or four $R_3$ substituents;

$R_2$ is aryl, aryl-amino, aryl-amino-carbonyl, heterocyclyl, heteroaryl or heteroaryl-amino;

wherein, each instance of aryl, heterocyclyl and heteroaryl is optionally substituted with one, two or three $R_6$ substituents and optionally, with one additional $R_7$ substituent;

$R_a$ is, in each instance, independently selected from hydrogen, halogen, $C_{1-8}$alkyl or deuterium;

$R_b$ is hydrogen, halogen, $C_{1-8}$alkyl, $C_{1-8}$alkoxy or deuterium;

$R_c$ is hydrogen, halogen, $C_{1-8}$alkyl or deuterium;

$R_3$ is, in each instance, independently selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl)$_2$-amino-$C_{1-8}$alkyl-amino-$C_{1-8}$alkyl-amino, ($C_{1-8}$alkyl)$_2$-amino-$C_{1-8}$alkyl-amino, [($C_{1-8}$alkyl)$_2$-amino-$C_{1-8}$alkyl]$_2$-amino, ($C_{1-8}$alkyl-amino-$C_{1-8}$alkyl)($C_{1-8}$alkyl)amino, [($C_{1-8}$alkyl)$_2$-amino-$C_{1-8}$alkyl]($C_{1-8}$alkyl)amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino;

$R_4$ is $C_{3-14}$cycloalkyl, $C_{3-14}$cycloalkyl-$C_{1-8}$alkyl, $C_{3-14}$cycloalkyl-amino, aryl-$C_{1-8}$alkyl, aryl-$C_{1-8}$alkoxy-carbonyl, aryl-sulfonyloxy-$C_{1-8}$alkyl, heterocyclyl or heterocyclyl-$C_{1-8}$alkyl; wherein, each instance of $C_{3-14}$cycloalkyl, aryl and heterocyclyl is optionally substituted with one, two or three $R_5$ substituents;

$R_5$ is, in each instance, independently selected from halogen, hydroxy, cyano, nitro, $C_{1-8}$alkyl, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio;

$R_6$ is, in each instance, independently selected from halogen, hydroxy, cyano, nitro, $C_{1-8}$alkyl, $C_{2-8}$alkenyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, amino, $C_{1-8}$alkyl-amino, ($C_{1-8}$alkyl)$_2$-amino or $C_{1-8}$alkyl-thio; and, $R_7$ is $C_{3-14}$cycloalkyl, $C_{3-14}$cycloalkyl-oxy, aryl, heterocyclyl or heteroaryl.

In one embodiment of the use of a compound of Formula (I), $w_1$ is C—$R_a$.

In another embodiment of the use of a compound of Formula (I), $w_1$ is N.

In one embodiment of the use of a compound of Formula (I), $w_2$ is C—$R_b$.

In another embodiment of the use of a compound of Formula (I), $w_2$ is N.

In one embodiment of the use of a compound of Formula (I), $w_3$ is C—$R_a$.

In another embodiment of the use of a compound of Formula (I), $w_3$ is N.

In one embodiment of the use of a compound of Formula (I), $w_4$ is C—$R_a$.

In another embodiment of the use of a compound of Formula (I), $w_4$ is N.

In one embodiment of the use of a compound of Formula (I), $w_5$ is C—$R_a$.

In another embodiment of the use of a compound of Formula (I), $w_5$ is N.

In one embodiment of the use of a compound of Formula (I), $w_6$ is C—$R_c$.

In another embodiment of the use of a compound of Formula (I), $w_6$ is N.

In one embodiment of the use of a compound of Formula (I), $w_7$ is C—$R_a$.

In another embodiment of the use of a compound of Formula (I), $w_7$ is N.

In one embodiment of the use of a compound of Formula (I), $w_3$ is C—$R_1$ and $w_6$ is C—$R_2$.

In another embodiment of the use of a compound of Formula (I), $w_3$ is C—$R_2$ and $w_6$ is C—$R_1$.

In one embodiment of the use of a compound of Formula (I), $w_4$ is C—$R_1$ and $w_7$ is C—$R_2$.

In another embodiment of the use of a compound of Formula (I), $w_4$ is C—$R_2$ and $w_7$ is C—$R_1$.

In one embodiment of the use of a compound of Formula (I), $w_3$ is C—$R_1$, $w_6$ is C—$R_2$ and $w_1$, $w_4$, $w_5$ and $w_7$ are independently C—$R_a$ or N and $w_2$ is C—$R_b$ or N.

In another embodiment of the use of a compound of Formula (I), $w_3$ is C—$R_2$, $w_6$ is C—$R_1$ and $w_1$, $w_4$, $w_5$ and $w_7$ are independently C—$R_a$ or N and $w_2$ is C—$R_b$ or N.

In one embodiment of the use of a compound of Formula (I), $w_4$ is C—$R_1$, $w_7$ is C—$R_2$, $w_1$, $w_3$ and $w_5$ are independently C—$R_a$ or N, $w_2$ is C—$R_b$ or N and $w_6$ is C—$R_c$ or N.

In another embodiment of the use of a compound of Formula (I), $w_4$ is C—$R_2$, $w_7$ is C—$R_1$, $w_1$, $w_3$ and $w_5$ are independently C—$R_a$ or N, $w_2$ is C—$R_b$ or N and $w_6$ is C—$R_c$ or N.

In one embodiment of the use of a compound of Formula (I), $w_1$ and $w_2$ are N.

In one embodiment of the use of a compound of Formula (I), $w_1$ and $w_3$ are N.

In one embodiment of the use of a compound of Formula (I), $w_1$ and $w_4$ are N.

In one embodiment of the use of a compound of Formula (I), $w_1$ and $w_5$ are N.

In one embodiment of the use of a compound of Formula (I), $w_1$ and $w_6$ are N.

In one embodiment of the use of a compound of Formula (I), $w_1$ and $w_7$ are N.

In one embodiment of the use of a compound of Formula (I), $R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)$_2$-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl; wherein, each instance of heterocyclyl, $C_{3-14}$cycloalkyl, aryl and heteroaryl is optionally substituted with $R_3$ and $R_4$ substituents.

In another embodiment of the use of a compound of Formula (I), $R_1$ is amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)$_2$-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino, [(hydroxy-$C_{1-8}$alkyl)($C_{1-8}$alkyl)amino-$C_{1-8}$alkyl]($C_{1-8}$alkyl)amino, heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl; wherein, each instance of heterocyclyl, $C_{3-14}$cycloalkyl, aryl and heteroaryl is optionally substituted with $R_3$ and $R_4$ substituents.

In another embodiment of the use of a compound of Formula (I), $R_1$ is $C_{1-8}$alkyl, amino, $C_{1-8}$alkyl-amino, ($C_{1-8}$alkyl)$_2$-amino, $C_{1-8}$alkoxy-$C_{1-8}$alkyl-amino, ($C_{1-8}$alkoxy-$C_{1-8}$alkyl)$_2$-amino, ($C_{1-8}$alkoxy-$C_{1-8}$alkyl)($C_{1-8}$alkyl)amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkoxy-$C_{1-8}$alkyl-amino-$C_{1-8}$alkyl, ($C_{1-8}$alkoxy-$C_{1-8}$alkyl)$_2$-amino-$C_{1-8}$alkyl, ($C_{1-8}$alkoxy-$C_{1-8}$alkyl)($C_{1-8}$alkyl)amino-$C_{1-8}$alkyl, amino-$C_{1-8}$alkyl-amino, (amino-$C_{1-8}$alkyl)$_2$-amino, (amino-$C_{1-8}$alkyl)($C_{1-8}$alkyl)amino, $C_{1-8}$alkyl-amino-$C_{1-8}$alkyl-amino, ($C_{1-8}$alkyl-amino-$C_{1-8}$alkyl)$_2$-amino, ($C_{1-8}$alkyl-amino-$C_{1-8}$alkyl)($C_{1-8}$alkyl)amino, ($C_{1-8}$alkyl)$_2$-amino-$C_{1-8}$alkyl-amino, [($C_{1-8}$alkyl)$_2$-amino-$C_{1-8}$alkyl]($C_{1-8}$alkyl)amino, amino-$C_{1-8}$alkoxy, $C_{1-8}$alkyl-amino-$C_{1-8}$alkoxy, ($C_{1-8}$alkyl)$_2$-amino-$C_{1-8}$alkoxy, $C_{1-8}$alkoxy-$C_{1-8}$alkyl-amino-$C_{1-8}$alkoxy, ($C_{1-8}$alkoxy-$C_{1-8}$alkyl)$_2$-amino-$C_{1-8}$alkoxy, ($C_{1-8}$alkoxy-$C_{1-8}$alkyl)($C_{1-8}$alkyl)amino-$C_{1-8}$alkoxy, amino-$C_{2-8}$alkenyl, $C_{1-8}$alkyl-amino-$C_{2-8}$alkenyl, ($C_{1-8}$alkyl)$_2$-amino-$C_{2-8}$alkenyl, amino-$C_{2-8}$alkynyl, $C_{1-8}$alkyl-amino-$C_{2-8}$alkynyl, ($C_{1-8}$alkyl)$_2$-amino-$C_{2-8}$alkynyl, halo-$C_{1-8}$alkyl-amino, (halo-$C_{1-8}$alkyl)$_2$-amino, (halo-$C_{1-8}$alkyl)($C_{1-8}$alkyl)amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino, (hydroxy-$C_{1-8}$alkyl)($C_{1-8}$alkyl)amino, hydroxy-$C_{1-8}$alkyl-amino-$C_{1-8}$alkyl, (hydroxy-$C_{1-8}$alkyl)$_2$-amino-$C_{1-8}$alkyl, (hydroxy-$C_{1-8}$alkyl)($C_{1-8}$alkyl)amino-$C_{1-8}$alkyl, hydroxy-$C_{1-8}$alkyl-amino-$C_{1-8}$alkoxy, (hydroxy-$C_{1-8}$alkyl)$_2$-amino-$C_{1-8}$alkoxy, (hydroxy-$C_{1-8}$alkyl)($C_{1-8}$alkyl)amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl)$_2$-amino, (hydroxy-$C_{1-8}$alkyl)$_2$-amino-$C_{1-8}$alkyl-amino, (hydroxy-$C_{1-8}$alkyl-amino-$C_{1-8}$alkyl)($C_{1-8}$alkyl)amino, (hydroxy-$C_{1-8}$alkyl)($C_{1-8}$alkyl)amino-$C_{1-8}$alkyl-amino, [(hydroxy-$C_{1-8}$alkyl)$_2$-amino-$C_{1-8}$alkyl]($C_{1-8}$alkyl)amino or [(hydroxy-$C_{1-8}$alkyl)($C_{1-8}$alkyl)amino-$C_{1-8}$alkyl]($C_{1-8}$alkyl)amino.

In another embodiment of the use of a compound of Formula (I), $R_1$ is heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyloxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl; wherein, each instance of heterocyclyl, $C_{3-14}$cycloalkyl, aryl and heteroaryl is optionally substituted with $R_3$ and $R_4$ substituents.

In another embodiment of the use of a compound of Formula (I), $R_1$ is heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl or heterocyclyl-carbonyloxy; wherein, each instance of heterocyclyl is optionally substituted with $R_3$ and $R_4$ substituents.

In another embodiment of the use of a compound of Formula (I), $R_1$ is heterocyclyl optionally substituted with $R_3$ and $R_4$ substituents.

In another embodiment of the use of a compound of Formula (I), $R_1$ is $C_{3-14}$cycloalkyl optionally substituted with $R_3$ and $R_4$ substituents.

In another embodiment of the use of a compound of Formula (I), $R_1$ is aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl or (aryl-$C_{1-8}$alkyl)($C_{1-8}$alkyl)amino-$C_{1-8}$alkyl; wherein, each instance of aryl is optionally substituted with $R_3$ and $R_4$ substituents.

In another embodiment of the use of a compound of Formula (I), $R_1$ is aryl-$C_{1-8}$alkyl-amino optionally substituted with $R_3$ and $R_4$ substituents.

In another embodiment of the use of a compound of Formula (I), $R_1$ is heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl; wherein, each instance of heterocyclyl, $C_{3-14}$cycloalkyl, aryl and heteroaryl is optionally substituted with $R_3$ and $R_4$ substituents.

In another embodiment of the use of a compound of Formula (I), $R_1$ is heteroaryl optionally substituted with $R_3$ and $R_4$ substituents.

In one embodiment of the use of a compound of Formula (I), $R_1$ is heterocyclyl selected from azetidinyl, tetrahydrofuranyl, pyrrolidinyl, piperidinyl, piperazinyl, 1,4-diazepanyl, 1,2,5,6-tetrahydropyridinyl, 1,2,3,6-tetrahydropyridinyl, hexahydropyrrolo[3,4-b]pyrrol-(1H)-yl, (3aS,6aS)-hexahydropyrrolo[3,4-b]pyrrol-(1H)-yl, (3aR,6aR)-hexahydropyrrolo[3,4-b]pyrrol-(1H)-yl, hexahydropyrrolo[3,4-b]pyrrol-(2H)-yl, (3aS,6aS)-hexahydropyrrolo[3,4-b]pyrrol-(2H)-yl, hexahydropyrrolo[3,4-c]pyrrol-(1H)-yl, (3aR,6aS)-hexahydropyrrolo[3,4-c]pyrrol-(1H)-yl, octahydro-5H-pyrrolo[3,2-c]pyridinyl, octahydro-6H-pyrrolo[3,4-b]pyridinyl, (4aR,7aR)-octahydro-6H-pyrrolo[3,4-b]pyridinyl, (4aS,7aS)-octahydro-6H-pyrrolo[3,4-b]pyridinyl, hexahydropyrrolo[1,2-c]pyrazin-(2H)-one, hexahydropyrrolo[1,2-c]pyrazin-(1H)-yl, (7R,8aS)-hexahydropyrrolo[1,2-c]pyrazin-(1H)-yl, (8aS)-hexahydropyrrolo[1,2-c]pyrazin-(1H)-yl, (8aR)-hexahydropyrrolo[1,2-c]pyrazin-(1H)-yl, (8aS)-octahydropyrrolo[1,2-c]pyrazin-(1H)-yl, (8aR)-octahydropyrrolo[1,2-c]pyrazin-(1H)-yl, octahydro-2H-pyrido[1,2-c]pyrazinyl, 3-azabicyclo[3.1.0]hexyl, (1R,5S)-3-azabicyclo[3.1.0]hexyl, 8-azabicyclo[3.2.1]octyl, (1R,5S)-8-azabicyclo[3.2.1]octyl, 8-azabicyclo[3.2.1]oct-2-enyl, (1R,5S)-8-azabicyclo[3.2.1]oct-2-enyl, 9-azabicyclo[3.3.1]nonyl, (1R,5S)-9-azabicyclo[3.3.1]nonyl, 2,5-diazabicyclo[2.2.1]heptyl, (1S,4S)-2,5-diazabicyclo[2.2.1]heptyl, 2,5-diazabicyclo[2.2.2]octyl, 3,8-diazabicyclo[3.2.1]octyl, (1R,5S)-3,8-diazabicyclo[3.2.1]octyl, 1,4-diazabicyclo[3.2.2]nonyl, azaspiro[3.3]heptyl, 2,6-diazaspiro[3.3]heptyl, 2,7-diazaspiro[3.5]nonyl, 5,8-diazaspiro[3.5]nonyl, 2,7-diazaspiro[4.4]nonyl or 6,9-diazaspiro[4.5]decyl; wherein, each instance of heterocyclyl is optionally substituted with $R_3$ and $R_4$ substituents.

In another embodiment of the use of a compound of Formula (I), $R_1$ is heterocyclyl selected from azetidin-1-yl, tetrahydrofuran-3-yl, pyrrolidin-1-yl, piperidin-1-yl, piperidin-4-yl, piperazin-1-yl, 1,4-diazepan-1-yl, 1,2,5,6-tetrahydropyridin-5-yl, 1,2,3,6-tetrahydropyridin-4-yl, hexahydropyrrolo[3,4-b]pyrrol-1(2H)-yl, (3aS,6aS)-hexahydropyrrolo[3,4-b]pyrrol-1(2H)-yl, (3aS,6aS)-hexahydropyrrolo[3,4-b]pyrrol-5(1H)-yl, (3aR,6aR)-hexahydropyrrolo[3,4-b]pyrrol-5(1H)-yl, hexahydropyrrolo[3,4-c]pyrrol-2(1H)-yl, (3aR,6aS)-hexahydropyrrolo[3,4-c]pyrrol-2(1H)-yl, octahydro-5H-pyrrolo[3,2-c]pyridin-5-yl, octahydro-6H-pyrrolo[3,4-b]pyridin-6-yl, (4aR,7aR)-octahydro-6H-pyrrolo[3,4-b]pyridin-6-yl, (4aS,7aS)-octahydro-6H-pyrrolo[3,4-b]pyridin-6-yl, hexahydropyrrolo[1,2-c]pyrazin-6(2H)-one, hexahydropyrrolo[1,2-c]pyrazin-2(1H)-yl, (7R,8aS)-hexahydropyrrolo[1,2-c]pyrazin-2(1H)-yl, (8aS)-hexahydropyrrolo[1,2-c]pyrazin-2(1H)-yl, (8aR)-hexahydropyrrolo[1,2-c]pyrazin-2(1H)-yl, (8aS)-octahydropyrrolo[1,2-c]pyrazin-2(1H)-yl, (8aR)-octahydropyrrolo[1,2-c]pyrazin-2(1H)-yl, octahydro-2H-pyrido[1,2-c]pyrazin-2-yl, 3-azabicyclo[3.1.0]hex-3-yl, 8-azabicyclo[3.2.1]oct-3-yl, (1R,5S)-8-azabicyclo[3.2.1]oct-3-yl, 8-azabicyclo[3.2.1]oct-2-en-3-yl, (1R,5S)-8-azabicyclo[3.2.1]oct-2-en-3-yl, 9-azabicyclo[3.3.1]non-3-yl, (1R,5S)-9-azabicyclo[3.3.1]non-3-yl, 2,5-diazabicyclo[2.2.1]hept-2-yl, (1S,4S)-2,5-diazabicyclo[2.2.1]hept-2-yl, 2,5-diazabicyclo[2.2.2]oct-2-yl, 3,8-diazabicyclo[3.2.1]oct-3-yl, (1R,5S)-3,8-diazabicyclo[3.2.1]oct-3-yl, 1,4-diazabicyclo[3.2.2]non-4-yl, azaspiro[3.3]hept-2-yl, 2,6-diazaspiro[3.3]hept-2-yl, 2,7-diazaspiro[3.5]non-7-yl, 5,8-diazaspiro[3.5]non-8-yl, 2,7-diazaspiro[4.4]non-2-yl or 6,9-diazaspiro[4.5]dec-9-yl; wherein, each instance of heterocyclyl is optionally substituted with $R_3$ and $R_4$ substituents.

In another embodiment of the use of a compound of Formula (I), $R_1$ is substituted heterocyclyl selected from 4-methyl-1,4-diazepan-1-yl, (3aS,6aS)-1-methylhexahydropyrrolo[3,4-b]pyrrol-5(1H)-yl, (3aS,6aS)-5-methylhexahydropyrrolo[3,4-b]pyrrol-1(2H)-yl, (3aR,6aR)-1-methylhexahydropyrrolo[3,4-b]pyrrol-5(1H)-yl, (3aR,6aS)-5-methylhexahydropyrrolo[3,4-c]pyrrol-2(1H)-yl, (3aR,6aS)-5-(2-hydroxyethyl)hexahydropyrrolo[3,4-c]pyrrol-2(1H)-yl, (3aR,6aS)-5-(propan-2-yl)hexahydropyrrolo[3,4-c]pyrrol-2(1H)-yl, (3aR,6aS)-5-ethylhexahydropyrrolo[3,4-c]pyrrol-2(1H)-yl, (4aR,7aR)-1-methyloctahydro-6H-pyrrolo[3,4-b]pyridin-6-yl, (4aR,7aR)-1-ethyloctahydro-6H-pyrrolo[3,4-b]pyridin-6-yl, (4aR,7aR)-1-(2-hydroxyethyl)octahydro-6H-pyrrolo[3,4-b]pyridin-6-yl, (4aS,7aS)-1-methyloctahydro-6H-pyrrolo[3,4-b]pyridin-6-yl, (4aS,7aS)-1-(2-hydroxyethyl)octahydro-6H-pyrrolo[3,4-b]pyridin-6-yl, (7R,8aS)-7-hydroxyhexahydropyrrolo[1,2-c]pyrazin-2(1H)-yl, (8aS)-8a-methyloctahydropyrrolo[1,2-c]pyrazin-2(1H)-yl, (8aR)-8a-methyloctahydropyrrolo[1,2-c]pyrazin-2(1H)-yl, (1R,5S,6s)-6-(dimethylamino)-3-azabicyclo[3.1.0]hex-3-yl, (1R,5S)-8-methyl-8-azabicyclo[3.2.1]oct-3-yl, 9-methyl-9-azabicyclo[3.3.1]non-3-yl, (3-exo)-9-methyl-9-azabicyclo[3.3.1]non-3-yl, (1R,5S)-9-methyl-9-azabicyclo[3.3.1]non-3-yl, (1S,4S)-5-methyl-2,5-diazabicyclo[2.2.1]hept-2-yl or (1S,4S)-5-ethyl-2,5-diazabicyclo[2.2.1]hept-2-yl.

In one embodiment of the use of a compound of Formula (I), $R_1$ is heterocyclyl-$C_{1-8}$alkyl, wherein heterocyclyl is selected from morpholinyl, piperidinyl, piperazinyl, imidazolyl or pyrrolidinyl; and, wherein, each instance of heterocyclyl is optionally substituted with $R_3$ and $R_4$ substituents.

In another embodiment of the use of a compound of Formula (I), $R_1$ is heterocyclyl-$C_{1-8}$alkyl selected from morpholin-4-yl-methyl, morpholin-4-yl-ethyl, morpholin-4-yl-propyl, piperidin-1-yl-methyl, piperazin-1-yl-methyl, piperazin-1-yl-ethyl, piperazin-1-yl-propyl, piperazin-1-yl-butyl, imidazol-1-yl-methyl, imidazol-1-yl-ethyl, imidazol-1-yl-propyl, imidazol-1-yl-butyl, pyrrolidin-1-yl-methyl, pyrrolidin-1-yl-ethyl, pyrrolidin-1-yl-propyl or pyrrolidin-1-yl-butyl; wherein, each instance of heterocyclyl is optionally substituted with $R_3$ and $R_4$ substituents.

In one embodiment of the use of a compound of Formula (I), $R_1$ is heterocyclyl-$C_{1-8}$alkoxy, wherein heterocyclyl is selected from pyrrolidinyl, piperidinyl or morpholinyl; and, wherein, each instance of heterocyclyl is optionally substituted with $R_3$ and $R_4$ substituents.

In another embodiment of the use of a compound of Formula (I), $R_1$ is heterocyclyl-$C_{1-8}$alkoxy selected from pyrrolidin-2-yl-methoxy, pyrrolidin-2-yl-ethoxy, pyrrolidin-1-yl-methoxy, pyrrolidin-1-yl-ethoxy, piperidin-1-yl-methoxy, piperidin-1-yl-ethoxy, morpholin-4-yl-methoxy or morpholin-4-yl-ethoxy; wherein, each instance of heterocyclyl is optionally substituted with $R_3$ and $R_4$ substituents.

In one embodiment of the use of a compound of Formula (I), $R_1$ is heterocyclyl-amino, wherein heterocyclyl is selected from azetidinyl, pyrrolidinyl, piperidinyl, 9-azabicyclo[3.3.1]nonyl or (1R,5S)-9-azabicyclo[3.3.1]nonyl; and, wherein, each instance of heterocyclyl is optionally substituted with $R_3$ and $R_4$ substituents.

In another embodiment of the use of a compound of Formula (I), $R_1$ is heterocyclyl-amino selected from azetidin-3-yl-amino, pyrrolidin-3-yl-amino, piperidin-4-yl-amino, 9-azabicyclo[3.3.1]non-3-yl-amino, (1R,5S)-9-azabicyclo[3.3.1]non-3-yl-amino, 9-methyl-9-azabicyclo[3.3.1]non-3-yl-amino, (3-exo)-9-methyl-9-azabicyclo[3.3.1]non-3-yl-amino or (1R,5S)-9-methyl-9-azabicyclo[3.3.1]non-3-yl-amino; wherein, each instance of heterocyclyl is optionally substituted with $R_3$ and $R_4$ substituents.

In one embodiment of the use of a compound of Formula (I), $R_1$ is (heterocyclyl)($C_{1-8}$alkyl)amino, wherein heterocyclyl is selected from pyrrolidinyl or piperidinyl; and, wherein, each instance of heterocyclyl is optionally substituted with $R_3$ and $R_4$ substituents.

In another embodiment of the use of a compound of Formula (I), $R_1$ is (heterocyclyl)($C_{1-8}$alkyl)amino selected from (pyrrolidin-3-yl)(methyl)amino or (piperidin-4-yl)(methyl)amino; wherein, each instance of heterocyclyl is optionally substituted with $R_3$ and $R_4$ substituents.

In one embodiment of the use of a compound of Formula (I), $R_1$ is heterocyclyl-amino-$C_{1-8}$alkyl, wherein heterocyclyl is selected from tetrahydrofuranyl; and, wherein, each instance of heterocyclyl is optionally substituted with $R_3$ and $R_4$ substituents.

In another embodiment of the use of a compound of Formula (I), $R_1$ is heterocyclyl-amino-$C_{1-8}$alkyl, selected from 3-(tetrahydrofuran-3-yl-amino)propyl; wherein, each instance of heterocyclyl is optionally substituted with $R_3$ and $R_4$ substituents.

In one embodiment of the use of a compound of Formula (I), $R_1$ is heterocyclyl-$C_{1-8}$alkyl-amino-$C_{1-8}$alkyl, wherein heterocyclyl is selected from tetrahydrofuranyl, thienyl or pyridinyl; and, wherein, each instance of heterocyclyl is optionally substituted with $R_3$ and $R_4$ substituents.

In another embodiment of the use of a compound of Formula (I), $R_1$ is heterocyclyl-$C_{1-8}$alkyl-amino-$C_{1-8}$alkyl, selected from 3-[(tetrahydrofuran-2-ylmethyl)amino]propyl, 3-[(thienyl-3-ylmethyl)amino]propyl, 3-[(pyridin-2-ylmethyl)amino]propyl or 3-[(pyridin-4-ylmethyl)amino]propyl; wherein, each instance of heterocyclyl is optionally substituted with $R_3$ and $R_4$ substituents.

In one embodiment of the use of a compound of Formula (I), $R_1$ is heterocyclyl-oxy, wherein heterocyclyl is selected from pyrrolidinyl or piperidinyl; and, wherein, each instance of heterocyclyl is optionally substituted with $R_3$ and $R_4$ substituents.

In another embodiment of the use of a compound of Formula (I), $R_1$ is heterocyclyl-oxy selected from pyrrolidin-3-yl-oxy or piperidin-4-yl-oxy; wherein, each instance of heterocyclyl is optionally substituted with $R_3$ and $R_4$ substituents.

In one embodiment of the use of a compound of Formula (I), $R_1$ is heterocyclyl-carbonyl, wherein heterocyclyl is selected from piperazinyl; and, wherein, each instance of heterocyclyl is optionally substituted with $R_3$ and $R_4$ substituents.

In another embodiment of the use of a compound of Formula (I), $R_1$ is heterocyclyl-carbonyl selected from piperazin-1-yl-carbonyl; wherein, each instance of heterocyclyl is optionally substituted with $R_3$ and $R_4$ substituents.

In one embodiment of the use of a compound of Formula (I), $R_1$ is heterocyclyl-carbonyl-oxy, wherein heterocyclyl is selected from piperazinyl; and, wherein, each instance of heterocyclyl is optionally substituted with $R_3$ and $R_4$ substituents.

In another embodiment of the use of a compound of Formula (I), $R_1$ is heterocyclyl-carbonyl-oxy selected from piperazin-1-yl-carbonyl-oxy; wherein, each instance of heterocyclyl is optionally substituted with $R_3$ and $R_4$ substituents.

In one embodiment of the use of a compound of Formula (I), $R_1$ is $C_{3-14}$cycloalkyl selected from cyclopropyl, cyclobutyl, cyclopentyl, cyclohexyl, cyclohexenyl or cycloheptyl; wherein, each instance of $C_{3-14}$cycloalkyl is optionally substituted with $R_3$ and $R_4$ substituents.

In another embodiment of the use of a compound of Formula (I), $R_1$ is $C_{3-8}$cycloalkyl selected from cyclopropyl, cyclobutyl, cyclopentyl, cyclohexyl, cyclohexenyl or cycloheptyl; wherein, each instance of $C_{3-8}$cycloalkyl is optionally substituted with $R_3$ and $R_4$ substituents.

In one embodiment of the use of a compound of Formula (I), $R_1$ is aryl-$C_{1-8}$alkyl-amino-$C_{1-8}$alkyl, wherein aryl is selected from phenyl; and, wherein, each instance of aryl is optionally substituted with $R_3$ and $R_4$ substituents.

In another embodiment of the use of a compound of Formula (I), $R_1$ is aryl-$C_{1-8}$alkyl-amino-$C_{1-8}$alkyl selected from 3-(benzylamino)propyl; wherein, each instance of aryl is optionally substituted with $R_3$ and $R_4$ substituents.

In one embodiment of the use of a compound of Formula (I), $R_1$ is heteroaryl, wherein heteroaryl is selected from pyridinyl; and, wherein, each instance of heteroaryl is optionally substituted with $R_3$ and $R_4$ substituents.

In another embodiment of the use of a compound of Formula (I), $R_1$ is heteroaryl selected from pyridin-4-yl; wherein, each instance of heteroaryl is optionally substituted with $R_3$ and $R_4$ substituents.

In one embodiment of the use of a compound of Formula (I), $R_1$ is heteroaryl-$C_{1-8}$alkyl, wherein heteroaryl is selected from 1H-imidazolyl; and, wherein, each instance of heteroaryl is optionally substituted with $R_3$ and $R_4$ substituents.

In another embodiment of the use of a compound of Formula (I), $R_1$ is heteroaryl-$C_{1-8}$alkyl selected from 1H-imidazol-1-yl-methyl; wherein, each instance of heteroaryl is optionally substituted with $R_3$ and $R_4$ substituents.

In one embodiment of the use of a compound of Formula (I), $R_1$ is (heteroaryl-$C_{1-8}$alkyl)($C_{1-8}$alkyl)amino, wherein heteroaryl is selected from pyridinyl; and, wherein, each instance of heteroaryl is optionally substituted with $R_3$ and $R_4$ substituents.

In another embodiment of the use of a compound of Formula (I), $R_1$ is (heteroaryl-$C_{1-8}$alkyl)($C_{1-8}$alkyl)amino selected from (pyridin-3-ylmethyl)(methyl)amino; wherein, each instance of heteroaryl is optionally substituted with $R_3$ and $R_4$ substituents.

In one embodiment of the use of a compound of Formula (I), $R_1$ is heteroaryl-$C_{1-8}$alkyl-amino-$C_{1-8}$alkyl, wherein heteroaryl is selected from thienyl or pyridinyl; and, wherein, each instance of heteroaryl is optionally substituted with $R_3$ and $R_4$ substituents.

In another embodiment of the use of a compound of Formula (I), $R_1$ is heteroaryl-$C_{1-8}$alkyl-amino-$C_{1-8}$alkyl selected from thien-3-yl-methyl-amino-propyl, pyridin-2-yl-methyl-amino-propyl, pyridin-3-yl-methyl-amino-propyl or pyridin-4-yl-methyl-amino-propyl; wherein, each instance of heteroaryl is optionally substituted with $R_3$ and $R_4$ substituents.

In one embodiment of the use of a compound of Formula (I), $R_3$ is selected from cyano, halogen, hydroxy, oxo, $C_{1-8}$alkyl, halo-$C_{1-8}$alkyl, $C_{1-8}$alkyl-carbonyl, $C_{1-8}$alkoxy, halo-$C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, amino-$C_{1-8}$alkyl-amino, $C_{1-8}$alkyl-amino-$C_{1-8}$alkyl-amino, ($C_{1-8}$alkyl)$_2$-amino-$C_{1-8}$alkyl-amino, $C_{1-8}$alkoxy-$C_{1-8}$alkyl-amino, $C_{1-8}$alkyl-carbonyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino.

In another embodiment of the use of a compound of Formula (I), $R_3$ is selected from cyano, halogen, hydroxy, oxo, $C_{1-8}$alkyl, halo-$C_{1-8}$alkyl, $C_{1-8}$alkoxy, $C_{1-8}$alkoxy-$C_{1-8}$alkyl, $C_{1-8}$alkoxy-carbonyl, amino, $C_{1-8}$alkyl-amino, ($C_{1-8}$alkyl)$_2$-amino, amino-$C_{1-8}$alkyl, $C_{1-8}$alkyl-amino-$C_{1-8}$alkyl, ($C_{1-8}$alkyl)$_2$-amino-$C_{1-8}$alkyl, $C_{1-8}$alkyl-amino-$C_{1-8}$alkyl-amino, $C_{1-8}$alkoxy-$C_{1-8}$alkyl-amino, $C_{1-8}$alkoxy-carbonyl-amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl)$_2$-amino or (hydroxy-$C_{1-8}$alkyl)($C_{1-8}$alkyl)amino.

In one embodiment of the use of a compound of Formula (I), $R_3$ is $C_{1-8}$alkyl selected from methyl, ethyl, propyl, isopropyl or tert-butyl.

In another embodiment of the use of a compound of Formula (I), $R_3$ is $C_{1-8}$alkyl selected from ethyl, propyl, isopropyl or tert-butyl.

In one embodiment of the use of a compound of Formula (I), $R_3$ is halo-$C_{1-8}$alkyl selected from trihalo-methyl, dihalo-methyl, halo-methyl, trihalo-ethyl, dihalo-ethyl, halo-ethyl, trihalo-propyl, dihalo-propyl or halo-propyl; wherein, halo is selected from fluoro, chloro, bromo or iodo.

In another embodiment of the use of a compound of Formula (I), $R_3$ is halo-$C_{1-8}$alkyl selected from trihalo-methyl, dihalo-methyl, halo-methyl, trihalo-ethyl, dihalo-ethyl, trihalo-propyl or dihalo-propyl; wherein, halo is selected from fluoro, chloro, bromo or iodo.

In one embodiment of the use of a compound of Formula (I), $R_3$ is hydroxy-$C_{1-8}$alkyl selected from hydroxy-methyl, hydroxy-ethyl, hydroxy-propyl, dihydroxy-propyl, hydroxy-butyl or dihydroxy-butyl.

In another embodiment of the use of a compound of Formula (I), $R_3$ is hydroxy-$C_{1-8}$alkyl selected from hydroxy-methyl, dihydroxy-propyl, hydroxy-butyl or dihydroxy-butyl.

In one embodiment of the use of compound of Formula (I), $R_3$ is $C_{1-8}$alkoxy selected from methoxy, ethoxy, propoxy or isopropoxy.

In one embodiment of the use of a compound of Formula (I), $R_3$ is halo-$C_{1-8}$alkoxy selected from trihalo-methoxy, dihalo-methoxy, halo-methoxy, trihalo-ethoxy, dihalo-ethoxy, halo-ethoxy, trihalo-propoxy, dihalo-propoxy or halo-propoxy; wherein, halo is selected from fluoro, chloro, bromo or iodo.

In one embodiment of the use of a compound of Formula (I), $R_3$ is $C_{1-8}$alkoxy-carbonyl-amino selected from methoxy-carbonyl-amino, ethoxy-carbonyl-amino, propoxy-carbonyl-amino, isopropoxy-carbonyl-amino, tert-butoxy-carbonyl-amino.

In one embodiment of the use of a compound of Formula (I), $R_a$ is, in each instance, independently selected from hydrogen, halogen, $C_{1-8}$alkyl.

In one embodiment of the use of a compound of Formula (I), $R_a$ is, in each instance, optionally and independently deuterium.

In one embodiment of the use of a compound of Formula (I), $R_b$ is hydrogen, halogen, $C_{1-8}$alkyl, $C_{1-8}$alkoxy.

In one embodiment of the use of a compound of Formula (I), $R_c$ is, in each instance, independently selected from hydrogen, halogen, $C_{1-8}$alkyl.

In one embodiment of the use of a compound of Formula (I), $R_c$ is, in each instance, optionally and independently deuterium.

In one embodiment of the use of a compound of Formula (I), $R_b$ is deuterium.

In one embodiment of the use of a compound of Formula (I), $R_4$ is $C_{3-14}$cycloalkyl selected from cyclopropyl, cyclobutyl, cyclopentyl, cyclohexyl or cycloheptyl; wherein, each instance of $C_{3-14}$cycloalkyl is optionally substituted with $R_5$ substituents.

In another embodiment of the use of a compound of Formula (I), $R_4$ is C3-8cycloalkyl selected from cyclopropyl, cyclobutyl, cyclopentyl, cyclohexyl or cycloheptyl; wherein, each instance of $C_{3-8}$cycloalkyl is optionally substituted with $R_5$ substituents.

In one embodiment of the use of a compound of Formula (I), $R_4$ is $C_{3-14}$cycloalkyl-$C_{1-8}$alkyl, wherein $C_{3-14}$cycloalkyl is selected from cyclopropyl, cyclobutyl, cyclopentyl, cyclohexyl or cycloheptyl; and, wherein, each instance of $C_{3-14}$cycloalkyl is optionally substituted with $R_5$ substituents.

In another embodiment of the use of a compound of Formula (I), $R_4$ is $C_{3-8}$cycloalkyl-$C_{1-8}$alkyl, wherein $C_{3-8}$cycloalkyl is selected from cyclopropyl, cyclobutyl, cyclopentyl, cyclohexyl or cycloheptyl; and, wherein, each instance of $C_{3-8}$cycloalkyl is optionally substituted with $R_5$ substituents.

In one embodiment of the use of a compound of Formula (I), $R_4$ is $C_{3-14}$cycloalkyl-amino, wherein $C_{3-14}$cycloalkyl is selected from cyclopropyl, cyclobutyl, cyclopentyl, cyclohexyl or cycloheptyl; and, wherein, each instance of $C_{3-14}$cycloalkyl is optionally substituted with $R_5$ substituents.

In another embodiment of the use of a compound of Formula (I), $R_4$ is $C_{3-8}$cycloalkyl-amino, wherein $C_{3-8}$cycloalkyl is selected from cyclopropyl, cyclobutyl, cyclopentyl, cyclohexyl or cycloheptyl; and, wherein, each instance of $C_{3-8}$cycloalkyl is optionally substituted with $R_5$ substituents.

In one embodiment of the use of a compound of Formula (I), $R_4$ is aryl-$C_{1-8}$alkyl, aryl-$C_{1-8}$alkoxy-carbonyl or aryl-sulfonyloxy-$C_{1-8}$alkyl, wherein aryl is selected from phenyl; and, wherein, each instance of aryl is optionally substituted with $R_5$ substituents.

In another embodiment of the use of a compound of Formula (I), $R_4$ is aryl-$C_{1-8}$alkyl or aryl-$C_{1-8}$alkoxy-carbonyl, wherein each instance of aryl is optionally substituted with $R_5$ substituents.

In one embodiment of the use of a compound of Formula (I), $R_4$ is heterocyclyl selected from oxetanyl, pyrrolidinyl, piperidinyl, piperazinyl, 1,3-dioxanyl or morpholinyl, wherein each instance of heterocyclyl is optionally substituted with $R_5$ substituents.

In another embodiment of the use of a compound of Formula (I), $R_4$ is heterocyclyl selected from oxetan-3-yl, pyrrolidin-1-yl, piperidin-1-yl, piperazin-1-yl, 1,3-dioxan-5-yl or morpholin-4-yl, wherein each instance of heterocyclyl is optionally substituted with $R_5$ substituents.

In one embodiment of the use of a compound of Formula (I), $R_4$ is heterocyclyl-$C_{1-8}$alkyl, wherein each instance of heterocyclyl is selected from pyrrolidinyl or piperidinyl; and, wherein, each instance of heterocyclyl is optionally substituted with $R_5$ substituents.

In another embodiment of the use of a compound of Formula (I), $R_4$ is heterocyclyl-$C_{1-8}$alkyl selected from pyrrolidin-1-yl-$C_{1-8}$alkyl or piperidin-1-yl-$C_{1-8}$alkyl, wherein each instance of heterocyclyl is optionally substituted with $R_5$ substituents.

In one embodiment of the use of a compound of Formula (I), $R_5$ is selected from halogen, hydroxy, cyano, nitro, halo-$C_{1-8}$alkyl, $C_{1-8}$alkoxy, halo-$C_{1-8}$alkoxy, amino, $C_{1-8}$alkyl-amino, ($C_{1-8}$alkyl)$_2$-amino or $C_{1-8}$alkyl-thio; wherein, halogen and halo is selected from fluoro, chloro, bromo or iodo.

In one embodiment of the use of a compound of Formula (I), $R_5$ is hydroxy.

In one embodiment of the use of a compound of Formula (I), $R_5$ is $C_{1-8}$alkyl selected from methyl, ethyl, propyl, isopropyl, n-butyl or tert-butyl.

In another embodiment of the use of a compound of Formula (I), $R_5$ is $C_{1-8}$alkyl selected from ethyl, propyl, isopropyl or tert-butyl.

In one embodiment of the use of a compound of Formula (I), $R_5$ is halo-$C_{1-8}$alkyl selected from trihalo-methyl, dihalo-methyl, halo-methyl, trihalo-ethyl, dihalo-ethyl, halo-ethyl, trihalo-propyl, dihalo-propyl or halo-propyl; wherein, halo is selected from fluoro, chloro, bromo or iodo.

In one embodiment of the use of a compound of Formula (I), $R_5$ is $C_{1-8}$alkoxy selected from methoxy, ethoxy, propoxy or isopropoxy.

In one embodiment of the use of a compound of Formula (I), $R_5$ is halo-$C_{1-8}$alkoxy selected from trihalo-methoxy, dihalo-methoxy, halo-methoxy, trihalo-ethoxy, dihalo-ethoxy, halo-ethoxy, trihalo-propoxy, dihalo-propoxy or halo-propoxy; wherein, halo is selected from fluoro, chloro, bromo or iodo.

In one embodiment of the use of a compound of Formula (I), $R_2$ is aryl selected from phenyl optionally substituted with $R_6$ and $R_7$ substituents.

In one embodiment of the use of a compound of Formula (I), $R_2$ is aryl-amino, wherein aryl is selected from phenyl; and, wherein, each instance of aryl is optionally substituted with $R_6$ and $R_7$ substituents.

In another embodiment of the use of a compound of Formula (I), $R_2$ is aryl-amino selected from phenyl-amino; wherein, each instance of aryl is optionally substituted with $R_6$ and $R_7$ substituents.

In one embodiment of the use of a compound of Formula (I), $R_2$ is aryl-amino-carbonyl, wherein aryl is selected from phenyl; and, wherein, each instance of aryl is optionally substituted with $R_6$ and $R_7$ substituents.

In another embodiment of the use of a compound of Formula (I), $R_2$ is aryl-amino-carbonyl selected from phenyl-amino-carbonyl; wherein, each instance of aryl is optionally substituted with $R_6$ and $R_7$ substituents.

In one embodiment of the use of a compound of Formula (I), $R_2$ is heterocyclyl selected from 1,2,3,6-tetrahydropyridinyl, 1,3-benzodioxolyl or 2,3-dihydro-1,4-benzodioxinyl; wherein, each instance of heterocyclyl is optionally substituted with $R_6$ and $R_7$ substituents.

In another embodiment of the use of a compound of Formula (I), $R_2$ is heterocyclyl selected from 1,2,3,6-tetrahydropyridin-4-yl, 1,3-benzodioxol-5-yl or 2,3-dihydro-1,4-benzodioxin-6-yl; wherein, each instance of heterocyclyl is optionally substituted with $R_6$ and $R_7$ substituents.

In one embodiment of the use of a compound of Formula (I), $R_2$ is heteroaryl selected from thienyl, 1H-pyrazolyl, 1H-imidazolyl, 1,3-thiazolyl, 1,2,4-oxadiazolyl, 1,3,4-oxadiazolyl, pyridinyl, pyrimidinyl, 1H-indolyl, 2H-indolyl, 1H-indazolyl, 2H-indazolyl, indolizinyl, benzofuranyl, benzothienyl, 1H-benzimidazolyl, 1,3-benzothiazolyl, 1,3-benzoxazolyl, 9H-purinyl, furo[3,2-b]pyridinyl, furo[3,2-c]pyridinyl, furo[2,3-c]pyridinyl, thieno[3,2-c]pyridinyl, thieno[2,3-d]pyrimidinyl, 1H-pyrrolo[2,3-b]pyridinyl, 1H-pyrrolo[2,3-c]pyridinyl, pyrrolo[1,2-c]pyrimidinyl, pyrrolo[1,2-c]pyrazinyl, pyrrolo[1,2-b]pyridazinyl, pyrazolo[1,5-c]pyridinyl, pyrazolo[1,5-c]pyrazinyl, imidazo[1,2-c]pyridinyl, imidazo[1,2-c]pyrimidinyl, imidazo[1,2-c]pyrimidinyl, imidazo[1,2-b]pyridazinyl, imidazo[1,2-c]pyrazinyl, imidazo[2,1-b][1,3]thiazolyl, imidazo[2,1-b][1,3,4]thiadiazolyl, [1,3]oxazolo[4,5-b]pyridinyl or quinoxalinyl; wherein, each instance of heteroaryl is optionally substituted with $R_6$ and $R_7$ substituents.

In another embodiment of the use of a compound of Formula (I), $R_2$ is heteroaryl selected from thien-2-yl, thien-3-yl, 1H-pyrazol-3-yl, 1H-pyrazol-4-yl, 1H-pyrazol-5-yl, 1H-imidazol-1-yl, 1H-imidazol-4-yl, 1,3-thiazol-2-yl, 1,2,4-oxadiazol-3-yl, 1,3,4-oxadiazol-2-yl, pyridin-2-yl, pyridin-3-yl, pyridin-4-yl, pyrimidin-4-yl, 1H-indol-3-yl, 1H-indol-4-yl, 1H-indol-5-yl, 1H-indol-6-yl, 1H-indazol-5-yl, 2H-indazol-5-yl, indolizin-2-yl, benzofuran-2-yl, benzofuran-5-yl, benzothien-2-yl, benzothien-3-yl, 1H-benzimidazol-2-yl, 1H-benzimidazol-6-yl, 1,3-benzoxazol-2-yl, 1,3-benzoxazol-5-yl, 1,3-benzoxazol-6-yl, 1,3-benzothiazol-2-yl, 1,3-benzothiazol-5-yl, 1,3-benzothiazol-6-yl, 9H-purin-8-yl, furo[3,2-b]pyridin-2-yl, furo[3,2-c]pyridin-2-yl, furo[2,3-c]pyridin-2-yl, thieno[3,2-c]pyridin-2-yl, thieno[2,3-d]pyrimidin-6-yl, 1H-pyrrolo[2,3-b]pyridin-5-yl, 1H-pyrrolo[2,3-c]pyridin-4-yl, pyrrolo[1,2-c]pyrimidin-7-yl, pyrrolo[1,2-c]pyrazin-7-yl, pyrrolo[1,2-b]pyridazin-2-yl, pyrazolo[1,5-c]pyridin-2-yl, pyrazolo[1,5-c]pyrazin-2-yl, imidazo[1,2-c]pyridin-2-yl, imidazo[1,2-c]pyridin-6-yl, imidazo[1,2-a]pyrimidin-2-yl, imidazo[1,2-a]pyrimidin-6-yl, imidazo[1,2-c]pyrimidin-2-yl, imidazo[1,2-b]pyridazin-2-yl, imidazo[1,2-c]pyrazin-2-yl, imidazo[2,1-b][1,3]thiazol-6-yl, imidazo[2,1-b][1,3,4]thiadiazol-6-yl, [1,3]oxazolo[4,5-b]pyridin-2-yl or quinoxalin-2-yl; wherein, each instance of heteroaryl is optionally substituted with $R_6$ and $R_7$ substituents.

In another embodiment of the use of a compound of Formula (I), $R_2$ is substituted heteroaryl selected from 4-methylthien-2-yl, 1-methyl-1H-pyrazol-3-yl, 4-methyl-1H-pyrazol-3-yl, 1-phenyl-1H-pyrazol-3-yl, 1-phenyl-1H-imidazol-4-yl, 2-methyl-1-(pyridin-2-yl)-1H-imidazol-4-yl, 4-methyl-1,3-thiazol-2-yl, 4-(trifluoromethyl)-1,3-thiazol-2-yl, 4-phenyl-1,3-thiazol-2-yl, 5-phenyl-1,2,4-oxadiazol-3-yl, 3-fluoropyridin-4-yl, 6-fluoropyridin-2-yl, 2-chloropyridin-4-yl, 4-chloropyridin-3-yl, 5-chloropyridin-2-yl, 6-methylpyridin-3-yl, 2-(trifluoromethyl)pyridin-3-yl, 4-(trifluoromethyl)pyridin-2-yl, 6-(trifluoromethyl)pyridin-2-yl, 2-methoxypyridin-4-yl, 4-methoxypyridin-3-yl, 6-methoxypyridin-2-yl, 2-ethoxypyridin-3-yl, 6-ethoxypyridin-2-yl, 6-(propan-2-yloxy)pyridin-2-yl, 6-(dimethylamino)pyridin-3-yl, 6-(methyl sulfanyl)pyridin-2-yl, 6-(cyclobutyloxy)pyridin-2-yl, 6-(pyrrolidin-1-yl)pyridin-2-yl, 2-methylpyrimidin-4-yl, 2-(propan-2-yl)pyrimidin-4-yl, 2-cyclopropylpyrimidin-4-yl, 1-methyl-1H-indol-3-yl, 2-methyl-2H-indazol-5-yl, 2-methyl-1-benzofuran-5-yl, 1-methyl-1H-benzimidazol-2-yl, 4-methyl-1H-benzimidazol-2-yl 5-fluoro-1H-benzimidazol-2-yl, 4-fluoro-1,3-benzoxazol-2-yl, 5-fluoro-1,3-benzoxazol-2-yl, 4-chloro-1,3-benzoxazol-2-yl, 4-iodo-1,3-benzoxazol-2-yl, 2-methyl-1,3-benzoxazol-6-yl, 4-methyl-1,3-benzoxazol-2-yl, 4-(trifluoromethyl)-1,3-benzoxazol-2-yl, 7-(trifluoromethyl)-1,3-benzoxazol-2-yl, 2-methyl-1,3-benzothiazol-2-yl, 2-methyl-1,3-benzothiazol-5-yl, 2-methyl-1,3-benzothiazol-6-yl, 4-chloro-1,3-benzothiazol-2-yl, 7-chloro-1,3-benzothiazol-2-yl, 4-(trifluoromethyl)-1,3-benzothiazol-2-yl, 5-methylfuro[3,2-b]pyridin-2-yl, 4,6-dimethylfuro[3,2-c]pyridin-2-yl, 5,7-dimethylfuro[2,3-c]pyridin-2-yl, 4,6-dimethylthieno[3,2-c]pyridin-2-yl, 2,4-dimethylthieno[2,3-d]pyrimidin-6-yl, 1-methylpyrrolo[1,2-c]pyrazin-7-yl, 3-methylpyrrolo[1,2-c]pyrazin-7-yl, 1,3-dimethylpyrrolo[1,2-c]pyrazin-7-yl, 2-methylpyrrolo[1,2-b]pyridazin-2-yl, 4,6-dimethylpyrazolo[1,5-c]pyrazin-2-yl, 5-methylpyrazolo[1,5-c]pyridin-2-yl, 4,6-dimethylpyrazolo[1,5-c]pyrazin-2-yl, 2-chloroimidazo[2,1-b][1,3]thiazol-6-yl, 2-methylimidazo[2,1-b][1,3]thiazol-6-yl, 3-methylimidazo[2,1-b][1,3]thiazol-6-yl, 2-ethylimidazo[2,1-b][1,3]thiazol-6-yl, 2-methylimidazo[2,1-b][1,3,4]thiadiazol-6-yl, 6-cyanoimidazo[1,2-c]pyridin-2-yl (also referred to as 2-imidazo[1,2-c]pyridine-6-carbonitrile), 6-fluoroimidazo[1,2-c]pyridin-2-yl, 8-fluoroimidazo[1,2-c]pyridin-2-yl, 6,8-difluoroimidazo[1,2-c]pyridin-2-yl, 7-(trifluoromethyl)imidazo[1,2-c]pyridin-2-yl, 8-(trifluoromethyl)imidazo[1,2-c]pyridin-2-yl, 6-chloroimidazo[1,2-c]pyridin-2-yl, 7-chloroimidazo[1,2-c]pyridin-2-yl, 8-chloroimidazo[1,2-c]pyridin-2-yl, 8-bromoimidazo[1,2-c]pyridin-2-yl, 2-methylimidazo[1,2-c]pyridin-2-yl, 5-methylimidazo[1,2-c]pyridin-2-yl, 6-methylimidazo[1,2-c]pyridin-2-yl, 7-methylimidazo[1,2-c]pyridin-2-yl, 8-methylimidazo[1,2-c]pyridin-2-yl, 7-ethylimidazo[1,2-c]pyridin-2-yl, 8-ethylimidazo[1,2-c]pyridin-2-yl, 6,8-dimethylimidazo[1,2-c]pyridin-2-yl, 8-ethyl-6-methylimidazo[1,2-c]pyridin-2-yl, 7-methoxyimidazo[1,2-c]pyridin-2-yl, 8-methoxyimidazo[1,2-c]pyridin-2-yl, 6-fluoro-8-methylimidazo[1,2-c]pyridin-2-yl, 8-fluoro-6-methylimidazo[1,2-c]pyridin-2-yl, 8-chloro-6-methylimidazo[1,2-a]pyridin-2-yl, 6-methyl-8-nitroimidazo[1,2-a]pyridin-2-yl, 8-cyclopropylimidazo[1,2-c]pyridin-2-yl, 2-methylimidazo[1,2-c]pyridin-6-yl, 2-ethylimidazo[1,2-c]pyridin-6-yl, 2,3-dimethylimidazo[1,2-c]pyridin-6-yl, 2,8-dimethylimidazo[1,2-c]pyridin-6-yl, 2-(trifluoromethyl)imidazo[1,2-c]pyridin-6-yl, 8-chloro-2-methylimidazo[1,2-c]pyridin-6-yl, 8-fluoro-2-methylimidazo[1,2-c]pyridin-6-yl, 6-fluoroimidazo[1,2-c]pyrimidin-2-yl, 6-chloroimidazo[1,2-c]pyrimidin-2-yl, 6-methylimidazo[1,2-c]pyrimidin-2-yl, 7-methylimidazo[1,2-c]pyrimidin-2-yl, 2-methylimidazo[1,2-c]pyrimidin-6-yl, 6-methylimidazo[1,2-b]pyridazin-2-yl, 2-methyl-3-(1,2,3,6-tetrahydropyridin-4-yl)imidazo[1,2-b]pyridazin-6-yl, 6-methylimidazo[1,2-c]pyrazin-2-yl, 8-methylimidazo[1,2-c]pyrazin-2-yl, 6,8-dimethylimidazo [1,2-c]pyrazin-2-yl, 6-chloro-8-methylimidazo[1,2-c] pyrazin-2-yl, 6-methyl-8-(trifluoromethyl)imidazo[1,2-c] pyrazin-2-yl, 8-(methylsulfanyl)imidazo[1,2-c]pyrazin-2-yl, 2-methylimidazo[2,1-b] [1,3]thiazol-6-yl, 3-methylimidazo [2,1-b][1,3]thiazol-6-yl or 2-methylimidazo[2,1-b][1,3,4] thiadiazol-6-yl.

In another embodiment of the use of a compound of Formula (I), $R_2$ is heteroaryl selected from thienyl, 1H-pyrazolyl, 1H-imidazolyl, 1,3-thiazolyl, 1,2,4-oxadiazolyl, 1,3,4-oxadiazolyl, pyridinyl, pyrimidinyl, 1H-indolyl, 2H-indolyl, 1H-indazolyl, 2H-indazolyl, indolizinyl, benzofuranyl, benzothienyl, 1H-benzimidazolyl, 1,3-benzothiazolyl, 1,3-benzoxazolyl, 9H-purinyl; wherein, each instance of heteroaryl is optionally substituted with $R_6$ and $R_7$ substituents.

In another embodiment of the use of a compound of Formula (I), $R_2$ is heteroaryl selected from furo[3,2-b]pyridinyl, furo [3,2-c]pyridinyl, furo[2,3-c]pyridinyl, thieno[3,2-c]pyridinyl, thieno[2,3-d]pyrimidinyl, 1H-pyrrolo[2,3-b]pyridinyl, 1H-pyrrolo[2,3-c]pyridinyl, pyrrolo[1,2-c]pyrimidinyl, pyrrolo[1,2-c]pyrazinyl, pyrrolo[1,2-b]pyridazinyl, pyrazolo[1, 5-c]pyridinyl, pyrazolo[1,5-c]pyrazinyl, imidazo[1,2-c] pyridinyl, imidazo[1,2-c]pyrimidinyl, imidazo[1,2-c] pyrimidinyl, imidazo[1,2-b]pyridazinyl, imidazo[1,2-c] pyrazinyl, imidazo[2,1-b][1,3]thiazolyl, imidazo[2,1-b][1,3, 4]thiadiazolyl, [1,3]oxazolo[4,5-b]pyridinyl or quinoxalinyl; wherein, each instance of heteroaryl is optionally substituted with $R_6$ and $R_7$ substituents.

In one embodiment of the use of a compound of Formula (I), $R_2$ is heteroaryl-amino, wherein heteroaryl is selected from pyridinyl or pyrimidinyl; and, wherein, each instance of heteroaryl is optionally substituted with $R_6$ and $R_7$ substituents.

In another embodiment of the use of a compound of Formula (I), $R_2$ is heteroaryl-amino selected from pyridin-2-yl-amino, pyridin-3-yl-amino or pyrimidin-2-yl-amino; wherein, each instance of heteroaryl is optionally substituted with $R_6$ and $R_7$ substituents.

In one embodiment of the use of a compound of Formula (I), $R_6$ is selected from halogen, hydroxy, cyano, nitro, $C_{1-8}$alkyl, halo-$C_{1-8}$alkyl, hydroxy-$C_{1-8}$alkyl, $C_{1-8}$alkoxy, halo-$C_{1-8}$alkoxy, $C_{1-8}$alkoxy-$C_{1-8}$alkyl, ($C_{1-8}$alkyl)$_2$-amino or $C_{1-8}$alkyl-thio; wherein, halogen and halo is selected from fluoro, chloro, bromo or iodo.

In one embodiment of the use of a compound of Formula (I), $R_6$ is $C_{1-8}$alkyl selected from methyl, ethyl, propyl, isopropyl or tert-butyl.

In another embodiment of the use of a compound of Formula (I), $R_6$ is $C_{1-8}$alkyl selected from ethyl, propyl, isopropyl or tert-butyl.

In one embodiment of the use of a compound of Formula (I), $R_6$ is $C_{2-8}$alkenyl selected from ethenyl, allyl or buta-1, 3-dienyl.

In another embodiment of the use of a compound of Formula (I), $R_6$ is $C_{2-8}$alkenyl selected from ethenyl or allyl.

In one embodiment of the use of a compound of Formula (I), $R_6$ is halo-$C_{1-8}$alkyl selected from trihalo-methyl, dihalo-methyl, halo-methyl, trihalo-ethyl, dihalo-ethyl, halo-ethyl, trihalo-propyl, dihalo-propyl or halo-propyl; wherein, halo is selected from fluoro, chloro, bromo or iodo.

In one embodiment of the use of a compound of Formula (I), $R_6$ is hydroxy-$C_{1-8}$alkyl selected from hydroxy-methyl, hydroxy-ethyl, hydroxy-propyl, dihydroxy-propyl, hydroxy-butyl or dihydroxy-butyl.

In another embodiment of the use of a compound of Formula (I), $R_6$ is hydroxy-$C_{1-8}$alkyl selected from hydroxy-methyl, dihydroxy-propyl, hydroxy-butyl or dihydroxy-butyl.

In one embodiment of the use of a compound of Formula (I), $R_6$ is $C_{1-8}$alkoxy selected from methoxy, ethoxy, propoxy or isopropoxy.

In one embodiment of the use of a compound of Formula (I), $R_6$ is halo-$C_{1-8}$alkoxy selected from trihalo-methoxy, dihalo-methoxy, halo-methoxy, trihalo-ethoxy, dihalo-ethoxy, halo-ethoxy, trihalo-propoxy, dihalo-propoxy or halo-propoxy; wherein, halo is selected from fluoro, chloro, bromo or iodo.

In one embodiment of the use of a compound of Formula (I), $R_7$ is $C_{3-14}$cycloalkyl, $C_{3-14}$cycloalkyl-oxy, aryl, heterocyclyl or heteroaryl; wherein $C_{3-14}$cycloalkyl is selected from cyclopropyl or cyclobutoxy; wherein aryl is selected from phenyl; wherein heterocyclyl is selected from oxetanyl, pyrrolidinyl or 1,2,3,6-tetrahydropyridinyl; and, wherein heteroaryl is selected from thienyl or pyridinyl.

In another embodiment of the use of a compound of Formula (I), $R_7$ is $C_{3-14}$cycloalkyl or $C_{3-14}$cycloalkyl-oxy, wherein each instance of $C_{3-14}$cycloalkyl is selected from cyclopropyl, cyclobutyl, cyclopentyl, cyclohexyl or cycloheptyl.

In another embodiment of the use of a compound of Formula (I), $R_7$ is $C_{3-8}$cycloalkyl or $C_{3-8}$cycloalkyl-oxy, wherein each instance of $C_{3-8}$cycloalkyl is selected from cyclopropyl, cyclobutyl, cyclopentyl, cyclohexyl or cycloheptyl.

In one embodiment of the use of a compound of Formula (I), $R_7$ is aryl selected from phenyl.

In one embodiment of the use of a compound of Formula (I), $R_7$ is heterocyclyl selected from oxetanyl, pyrrolidinyl or 1,2,3,6-tetrahydropyridinyl.

In another embodiment of the use of a compound of Formula (I), $R_7$ is heterocyclyl selected from oxetan-3-yl, pyrrolidin-1-yl or 1,2,3,6-tetrahydropyridin-4-yl.

In one embodiment of the use of a compound of Formula (I), $R_7$ is heteroaryl selected from thienyl or pyridinyl.

In another embodiment of the use of a compound of Formula (I), $R_7$ is heteroaryl selected from pyridinyl.

In one embodiment of the use of a compound of Formula (I), $R_7$ is heteroaryl selected from thien-2-yl or pyridin-2-yl.

In another embodiment of the use of a compound of Formula (I), $R_7$ is heteroaryl selected from pyridin-2-yl.

In one embodiment of the use of a compound of Formula (I), $R_c$ is hydrogen or $C_{1-8}$alkyl.

In another embodiment of the use of a compound of Formula (I), $R_1$ is heterocyclyl, heterocyclyl-$C_{1-8}$alkyl, heterocyclyl-$C_{1-8}$alkoxy, heterocyclyl-amino, (heterocyclyl)($C_{1-8}$alkyl) amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino- $C_{1-8}$alkyl; wherein, each instance of heterocyclyl, $C_{3-14}$cycloalkyl, aryl and heteroaryl is optionally substituted with $R_3$ and $R_4$ substituents; and, wherein, heterocyclyl is selected from azetidinyl, tetrahydrofuranyl, pyrrolidinyl, piperidinyl, piperazinyl, 1,4-diazepanyl, 1,2,5,6-tetrahydropyridinyl, 1,2,3,6-tetrahydropyridinyl, hexahydropyrrolo[3,4-b]pyrrol-(1H)-yl, (3aS,6aS)-hexahydropyrrolo[3,4-b]pyrrol-(1H)-yl, (3aR,6aR)-hexahydropyrrolo[3,4-b]pyrrol-(1H)-yl, hexahydropyrrolo[3,4-b]pyrrol-(2H)-yl, (3aS,6aS)-hexahydropyrrolo[3,4-b]pyrrol-(2H)-yl, hexahydropyrrolo[3,4-c]pyrrol-(1H)-yl, (3aR,6aS)-hexahydropyrrolo[3,4-c]pyrrol-(1H)-yl, octahydro-5H-pyrrolo[3,2-c]pyridinyl, octahydro-6H-pyrrolo[3,4-b]pyridinyl, (4aR,7aR)-octahydro-6H-pyrrolo[3,4-b]pyridinyl, (4aS,7aS)-octahydro-6H-pyrrolo[3,4-b]pyridinyl, hexahydropyrrolo[1,2-c]pyrazin-(2H)-one, hexahydropyrrolo[1,2-c]pyrazin-(1H)-yl, (7R,8aS)-hexahydropyrrolo[1,2-c]pyrazin-(1H)-yl, (8aS)-hexahydropyrrolo[1,2-c]pyrazin-(1H)-yl, (8aR)-hexahydropyrrolo[1,2-c]pyrazin-(1H)-yl, (8aS)-octahydropyrrolo[1,2-c]pyrazin-(1H)-yl, (8aR)-octahydropyrrolo[1,2-c]pyrazin-(1H)-yl, octahydro-2H-pyrido[1,2-c]pyrazinyl, 3-azabicyclo[3.1.0]hexyl, (1R,5S)-3-azabicyclo[3.1.0]hexyl, 8-azabicyclo[3.2.1]octyl, (1R,5S)-8-azabicyclo[3.2.1]octyl, 8-azabicyclo[3.2.1]oct-2-enyl, (1R,5S)-8-azabicyclo[3.2.1]oct-2-enyl, 9-azabicyclo[3.3.1]nonyl, (1R,5S)-9-azabicyclo[3.3.1]nonyl, 2,5-diazabicyclo[2.2.1]heptyl, (1S,4S)-2,5-diazabicyclo[2.2.1]heptyl, 2,5-diazabicyclo[2.2.2]octyl, 3,8-diazabicyclo[3.2.1]octyl, (1R,5S)-3,8-diazabicyclo[3.2.1]octyl, 1,4-diazabicyclo[3.2.2]nonyl, azaspiro[3.3]heptyl, 2,6-diazaspiro[3.3]heptyl, 2,7-diazaspiro[3.5]nonyl, 5,8-diazaspiro[3.5]nonyl, 2,7-diazaspiro[4.4]nonyl or 6,9-diazaspiro[4.5]decyl.

In another embodiment of the use of a compound of Formula (I), $R_2$ is aryl, aryl-amino, aryl-amino-carbonyl, heterocyclyl, heteroaryl or heteroaryl-amino;

wherein, aryl is phenyl;

wherein, heterocyclyl is selected from 1,2,3,6-tetrahydropyridinyl, 1,3-benzodioxolyl or 2,3-dihydro-1,4-benzodioxinyl;

wherein, heteroaryl is selected from thienyl, 1H-pyrazolyl, 1H-imidazolyl, 1,3-thiazolyl, 1,2,4-oxadiazolyl, 1,3,4-oxadiazolyl, pyridinyl, pyrimidinyl, 1H-indolyl, 2H-indolyl, 1H-indazolyl, 2H-indazolyl, indolizinyl, benzofuranyl, benzothienyl, 1H-benzimidazolyl, 1,3-benzothiazolyl, 1,3-benzoxazolyl, 9H-purinyl, furo[3,2-b]pyridinyl, furo[3,2-c]pyridinyl, furo[2,3-c]pyridinyl, thieno[3,2-c]pyridinyl, thieno[2,3-d]pyrimidinyl, 1H-pyrrolo[2,3-b]pyridinyl, 1H-pyrrolo[2,3-c]pyridinyl, pyrrolo[1,2-c]pyrimidinyl, pyrrolo[1,2-c]pyrazinyl, pyrrolo[1,2-b]pyridazinyl, pyrazolo[1,5-c]pyridinyl, pyrazolo[1,5-c]pyrazinyl, imidazo[1,2-c]pyridinyl, imidazo[1,2-c]pyrimidinyl, imidazo[1,2-c]pyrimidinyl, imidazo[1,2-b]pyridazinyl, imidazo[1,2-c]pyrazinyl, imidazo[2,1-b][1,3]thiazolyl, imidazo[2,1-b][1,3,4]thiadiazolyl, [1,3]oxazolo[4,5-b]pyridinyl or quinoxalinyl; and, wherein, each instance of aryl, heterocyclyl and heteroaryl is optionally substituted with $R_6$ and $R_7$ substituents.

In another embodiment of the use of a compound of Formula (I), $R_1$ is heterocyclyl, heterocyclyl-$C_{1-8}$alkyl, heterocyclyl-$C_{1-8}$alkoxy, heterocyclyl-amino, (heterocyclyl)($C_{1-8}$alkyl)amino, heterocyclyl-amino-$C_{1-8}$alkyl, heterocyclyl-$C_{1-8}$alkyl-amino, (heterocyclyl-$C_{1-8}$alkyl)$_2$-amino, (heterocyclyl-$C_{1-8}$alkyl)($C_{1-8}$alkyl)amino, heterocyclyl-$C_{1-8}$alkyl-amino-$C_{1-8}$alkyl, (heterocyclyl-$C_{1-8}$alkyl)$_2$-amino-$C_{1-8}$alkyl, (heterocyclyl-$C_{1-8}$alkyl)($C_{1-8}$alkyl)amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl)$_2$-amino, (aryl-$C_{1-8}$alkyl)($C_{1-8}$alkyl)amino, aryl-$C_{1-8}$alkyl-amino-$C_{1-8}$alkyl, (aryl-$C_{1-8}$alkyl)$_2$-amino-$C_{1-8}$alkyl, (aryl-$C_{1-8}$alkyl)($C_{1-8}$alkyl)amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl)$_2$-amino, (heteroaryl-$C_{1-8}$alkyl)($C_{1-8}$alkyl)amino, heteroaryl-$C_{1-8}$alkyl-amino-$C_{1-8}$alkyl, (heteroaryl-$C_{1-8}$alkyl)$_2$-amino-$C_{1-8}$alkyl or (heteroaryl-$C_{1-8}$alkyl)($C_{1-8}$alkyl)amino-$C_{1-8}$alkyl;

wherein, heterocyclyl is selected from azetidinyl, tetrahydrofuranyl, pyrrolidinyl, piperidinyl, piperazinyl, 1,4-diazepanyl, 1,2,5,6-tetrahydropyridinyl, 1,2,3,6-tetrahydropyridinyl, hexahydropyrrolo[3,4-b]pyrrol-(1H)-yl, (3aS,6aS)-hexahydropyrrolo[3,4-b]pyrrol-(1H)-yl, (3aR,6aR)-hexahydropyrrolo[3,4-b]pyrrol-(1H)-yl, hexahydropyrrolo[3,4-b]pyrrol-(2H)-yl, (3aS,6aS)-hexahydropyrrolo[3,4-b]pyrrol-(2H)-yl, hexahydropyrrolo[3,4-c]pyrrol-(1H)-yl, (3aR,6aS)-hexahydropyrrolo[3,4-c]pyrrol-(1H)-yl, octahydro-5H-pyrrolo[3,2-c]pyridinyl, octahydro-6H-pyrrolo[3,4-b]pyridinyl, (4aR,7aR)-octahydro-6H-pyrrolo[3,4-b]pyridinyl, (4aS,7aS)-octahydro-6H-pyrrolo[3,4-b]pyridinyl, hexahydropyrrolo[1,2-c]pyrazin-(2H)-one, hexahydropyrrolo[1,2-c]pyrazin-(1H)-yl, (7R,8aS)-hexahydropyrrolo[1,2-c]pyrazin-(1H)-yl, (8aS)-hexahydropyrrolo[1,2-c]pyrazin-(1H)-yl, (8aR)-hexahydropyrrolo[1,2-c]pyrazin-(1H)-yl, (8aS)-octahydropyrrolo[1,2-c]pyrazin-(1H)-yl, (8aR)-octahydropyrrolo[1,2-c]pyrazin-(1H)-yl, octahydro-2H-pyrido[1,2-c]pyrazinyl, 3-azabicyclo[3.1.0]hexyl, (1R,5S)-3-azabicyclo[3.1.0]hexyl, 8-azabicyclo[3.2.1]octyl, (1R,5S)-8-azabicyclo[3.2.1]octyl, 8-azabicyclo[3.2.1]oct-2-enyl, (1R,5S)-8-azabicyclo[3.2.1]oct-2-enyl, 9-azabicyclo[3.3.1]nonyl, (1R,5S)-9-azabicyclo[3.3.1]nonyl, 2,5-diazabicyclo[2.2.1]heptyl, (1S,4S)-2,5-diazabicyclo[2.2.1]heptyl, 2,5-diazabicyclo[2.2.2]octyl, 3,8-diazabicyclo[3.2.1]octyl, (1R,5S)-3,8-diazabicyclo[3.2.1]octyl, 1,4-diazabicyclo[3.2.2]nonyl, azaspiro[3.3]heptyl, 2,6-diazaspiro[3.3]heptyl, 2,7-diazaspiro[3.5]nonyl, 5,8-diazaspiro[3.5]nonyl, 2,7-diazaspiro[4.4]nonyl or 6,9-diazaspiro[4.5]decyl; and, wherein, each instance of heterocyclyl, $C_{3-14}$cycloalkyl, aryl and heteroaryl is optionally substituted with $R_3$ and $R_4$ substituents; and $R_2$ is aryl, aryl-amino, aryl-amino-carbonyl, heterocyclyl, heteroaryl or heteroaryl-amino;

wherein, heterocyclyl is selected from 1,2,3,6-tetrahydropyridin-4-yl, 1,3-benzodioxol-5-yl or 2,3-dihydro-1,4-benzodioxin-6-yl;

wherein, heteroaryl is selected from thienyl, 1H-pyrazolyl, 1H-imidazolyl, 1,3-thiazolyl, 1,2,4-oxadiazolyl, 1,3,4-oxadiazolyl, pyridinyl, pyrimidinyl, 1H-indolyl, 2H-indolyl, 1H-indazolyl, 2H-indazolyl, indolizinyl, benzofuranyl, benzothienyl, 1H-benzimidazolyl, 1,3-benzothiazolyl, 1,3-benzoxazolyl, 9H-purinyl, furo[3,2-b]pyridinyl, furo[3,2-c]pyridinyl, furo[2,3-c]pyridinyl, thieno[3,2-c]pyridinyl, thieno[2,3-d]pyrimidinyl, 1H-pyrrolo[2,3-b]pyridinyl, 1H-pyrrolo[2,3-c]pyridinyl, pyrrolo[1,2-c]pyrimidinyl, pyrrolo[1,2-c]pyrazinyl, pyrrolo[1,2-b]pyridazinyl, pyrazolo[1,5-c]pyridinyl, pyrazolo[1,5-c]pyrazinyl, imidazo[1,2-c]pyridinyl, imidazo[1,2-c]pyrimidinyl, imidazo[1,2-c]pyrimidinyl, imidazo[1,2-b]pyridazinyl, imidazo[1,2-c]pyrazinyl, imidazo[2,1-b][1,3]thiazolyl, imidazo[2,1-b][1,3,4]thiadiazolyl, [1,3]oxazolo[4,5-b]pyridinyl or quinoxalinyl; and, wherein, each instance of heterocyclyl and heteroaryl is optionally substituted with $R_6$ and $R_7$ substituents.

In another embodiment of the use of a compound of Formula (I), $R_1$ is $C_{1-8}$alkyl, amino, $C_{1-8}$alkyl-amino, $(C_{1-8}$alkyl$)_2$-amino, $C_{1-8}$alkoxy-$C_{1-8}$alkyl-amino, $(C_{1-8}$alkoxy-$C_{1-8}$alkyl$)_2$-amino, $(C_{1-8}$alkoxy-$C_{1-8}$alkyl$)(C_{1-8}$alkyl$)$amino, amino-$C_{1-8}$alkyl, $C_{1-8}$alkyl-amino-$C_{1-8}$alkyl, $(C_{1-8}$alkyl$)_2$-amino-$C_{1-8}$alkyl, $C_{1-8}$alkoxy-$C_{1-8}$alkyl-amino-$C_{1-8}$alkyl, $(C_{1-8}$alkoxy-$C_{1-8}$alkyl$)_2$-amino-$C_{1-8}$alkyl, $(C_{1-8}$alkoxy-$C_{1-8}$alkyl$)(C_{1-8}$alkyl$)$amino-$C_{1-8}$alkyl, amino-$C_{1-8}$alkyl-amino, (amino-$C_{1-8}$alkyl$)_2$-amino, (amino-$C_{1-8}$alkyl)$(C_{1-8}$alkyl$)$amino, $C_{1-8}$alkyl-amino-$C_{1-8}$alkyl-amino, $(C_{1-8}$alkyl-amino-$C_{1-8}$alkyl$)_2$-amino, $(C_{1-8}$alkyl-amino-$C_{1-8}$alkyl$)(C_{1-8}$alkyl$)$amino, $(C_{1-8}$alkyl$)_2$-amino-$C_{1-8}$alkyl-amino, $[(C_{1-8}$alkyl$)_2$-amino-$C_{1-8}$alkyl$](C_{1-8}$alkyl$)$amino, amino-$C_{1-8}$alkoxy, $C_{1-8}$alkyl-amino-$C_{1-8}$alkoxy, $(C_{1-8}$alkyl$)_2$-amino-$C_{1-8}$alkoxy, $C_{1-8}$alkoxy-$C_{1-8}$alkyl-amino-$C_{1-8}$alkoxy, $(C_{1-8}$alkoxy-$C_{1-8}$alkyl$)_2$-amino-$C_{1-8}$alkoxy, $(C_{1-8}$alkoxy-$C_{1-8}$alkyl$)(C_{1-8}$alkyl$)$amino-$C_{1-8}$alkoxy, amino-$C_{2-8}$alkenyl, $C_{1-8}$alkyl-amino-$C_{2-8}$alkenyl, $(C_{1-8}$alkyl$)_2$-amino-$C_{2-8}$alkenyl, amino-$C_{2-8}$alkynyl, $C_{1-8}$alkyl-amino-$C_{2-8}$alkynyl, $(C_{1-8}$alkyl$)_2$-amino-$C_{2-8}$alkynyl, halo-$C_{1-8}$alkyl-amino, (halo-$C_{1-8}$alkyl$)_2$-amino, (halo-$C_{1-8}$alkyl$)(C_{1-8}$alkyl$)$amino, hydroxy-$C_{1-8}$alkyl, hydroxy-$C_{1-8}$alkoxy-$C_{1-8}$alkyl, hydroxy-$C_{1-8}$alkyl-amino, (hydroxy-$C_{1-8}$alkyl$)_2$-amino, (hydroxy-$C_{1-8}$alkyl$)(C_{1-8}$alkyl$)$amino, hydroxy-$C_{1-8}$alkyl-amino-$C_{1-8}$alkyl, (hydroxy-$C_{1-8}$alkyl$)_2$-amino-$C_{1-8}$alkyl, (hydroxy-$C_{1-8}$alkyl$)(C_{1-8}$alkyl$)$amino-$C_{1-8}$alkyl, hydroxy-$C_{1-8}$alkyl-amino-$C_{1-8}$alkoxy, (hydroxy-$C_{1-8}$alkyl$)_2$-amino-$C_{1-8}$alkoxy, (hydroxy-$C_{1-8}$alkyl$)(C_{1-8}$alkyl$)$amino-$C_{1-8}$alkoxy, hydroxy-$C_{1-8}$alkyl-amino-$C_{1-8}$alkyl-amino, (hydroxy-$C_{1-8}$alkyl-amino-$C_{1-8}$alkyl$)_2$-amino, (hydroxy-$C_{1-8}$alkyl$)_2$-amino-$C_{1-8}$alkyl-amino, (hydroxy-$C_{1-8}$alkyl-amino-$C_{1-8}$alkyl$)(C_{1-8}$alkyl$)$amino, (hydroxy-$C_{1-8}$alkyl$)(C_{1-8}$alkyl$)$amino-$C_{1-8}$alkyl-amino, $[($hydroxy-$C_{1-8}$alkyl$)_2$-amino-$C_{1-8}$alkyl$](C_{1-8}$alkyl$)$amino or $[($hydroxy-$C_{1-8}$alkyl$)(C_{1-8}$alkyl$)$amino-$C_{1-8}$alkyl$](C_{1-8}$alkyl$)$amino; and $R_2$ is aryl, aryl-amino, aryl-amino-carbonyl, heterocyclyl, heteroaryl or heteroaryl-amino, wherein, each instance of aryl, heterocyclyl and heteroaryl is optionally substituted with $R_6$ and $R_7$ substituents.

In another embodiment of the use of a compound of Formula (I), $R_1$ is heterocyclyl, heterocyclyl-$C_{1-8}$alkyl, heterocyclyl-$C_{1-8}$alkoxy, heterocyclyl-amino, (heterocyclyl)$(C_{1-8}$alkyl$)$amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl$)(C_{1-8}$alkyl$)$amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl$)(C_{1-8}$alkyl$)$amino-$C_{1-8}$alkyl, heterocyclyl-oxy, heterocyclyl-carbonyl, heterocyclyl-carbonyl-oxy, $C_{3-14}$cycloalkyl, aryl-$C_{1-8}$alkyl-amino, (aryl-$C_{1-8}$alkyl$)_2$-amino, (aryl-$C_{1-8}$alkyl$)(C_{1-8}$alkyl$)$amino, aryl-$C_{1-8}$alkyl-amino-$C_{1-8}$alkyl, (aryl-$C_{1-8}$alkyl$)_2$-amino-$C_{1-8}$alkyl, (aryl-$C_{1-8}$alkyl$)(C_{1-8}$alkyl$)$amino-$C_{1-8}$alkyl, heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl$)(C_{1-8}$alkyl$)$amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl$)(C_{1-8}$alkyl$)$amino-$C_{1-8}$alkyl; wherein, each instance of heterocyclyl, $C_{3-14}$cycloalkyl, aryl and heteroaryl is optionally substituted with $R_3$ and $R_4$ substituents; and $R_2$ is aryl, aryl-amino, aryl-amino-carbonyl, heterocyclyl, heteroaryl or heteroaryl-amino, wherein, each instance of aryl, heterocyclyl and heteroaryl is optionally substituted with $R_6$ and $R_7$ substituents.

In another embodiment of the use of a compound of Formula (I), $R_1$ is heterocyclyl, heterocyclyl-$C_{1-8}$alkyl, heterocyclyl-$C_{1-8}$alkoxy, heterocyclyl-amino, (heterocyclyl)$(C_{1-8}$alkyl$)$amino, heterocyclyl-amino-$C_{1-8}$alkyl, heterocyclyl-$C_{1-8}$alkyl-amino, (heterocyclyl-$C_{1-8}$alkyl$)_2$-amino, (heterocyclyl-$C_{1-8}$alkyl$)(C_{1-8}$alkyl$)$amino, heterocyclyl-$C_{1-8}$alkyl-amino-$C_{1-8}$alkyl, (heterocyclyl-$C_{1-8}$alkyl$)_2$-amino-$C_{1-8}$alkyl, (heterocyclyl-$C_{1-8}$alkyl$)(C_{1-8}$alkyl$)$amino-$C_{1-8}$alkyl, heterocyclyl-oxy, heterocyclyl-carbonyl or heterocyclyl-carbonyl-oxy; wherein, each instance of heterocyclyl is optionally substituted with $R_3$ and $R_4$ substituents; and $R_2$ is aryl, aryl-amino, aryl-amino-carbonyl, heterocyclyl, heteroaryl or heteroaryl-amino, wherein, each instance of aryl, heterocyclyl and heteroaryl is optionally substituted with $R_6$ and $R_7$ substituents.

In another embodiment of the use of a compound of Formula (I), $R_1$ is heterocyclyl optionally substituted with $R_3$ and $R_4$ substituents; and $R_2$ is aryl, aryl-amino, aryl-amino-carbonyl, heterocyclyl, heteroaryl or heteroaryl-amino, wherein, each instance of aryl, heterocyclyl and heteroaryl is optionally substituted with $R_6$ and $R_7$ substituents.

In another embodiment of the use of a compound of Formula (I), $R_1$ is $C_{3-14}$cycloalkyl optionally substituted with $R_3$ and $R_4$ substituents; and $R_2$ is aryl, aryl-amino, aryl-amino-carbonyl, heterocyclyl, heteroaryl or heteroaryl-amino, wherein, each instance of aryl, heterocyclyl and heteroaryl is optionally substituted with $R_6$ and $R_7$ substituents.

In another embodiment of the use of a compound of Formula (I), $R_1$ is aryl-$C_{1-8}$alkyl-amino, (aryl-$C_{1-8}$alkyl$)_2$-amino, (aryl-$C_{1-8}$alkyl$)(C_{1-8}$alkyl$)$amino, aryl-$C_{1-8}$alkyl-amino-$C_{1-8}$alkyl, (aryl-$C_{1-8}$alkyl$)_2$-amino-$C_{1-8}$alkyl or (aryl-$C_{1-8}$alkyl$)(C_{1-8}$alkyl$)$amino-$C_{1-8}$alkyl; wherein, each instance of aryl is optionally substituted with $R_3$ and $R_4$ substituents; and $R_2$ is aryl, aryl-amino, aryl-amino-carbonyl, heterocyclyl, heteroaryl or heteroaryl-amino, wherein, each instance of aryl, heterocyclyl and heteroaryl is optionally substituted with $R_6$ and $R_7$ substituents.

In another embodiment of the use of a compound of Formula (I), $R_1$ is aryl-$C_{1-8}$alkyl-amino optionally substituted with $R_3$ and $R_4$ substituents; and $R_2$ is aryl, aryl-amino, aryl-amino-carbonyl, heterocyclyl, heteroaryl or heteroaryl-amino, wherein, each instance of aryl, heterocyclyl and heteroaryl is optionally substituted with $R_6$ and $R_7$ substituents.

In another embodiment of the use of a compound of Formula (I), $R_1$ is heteroaryl, heteroaryl-$C_{1-8}$alkyl, heteroaryl-$C_{1-8}$alkoxy, heteroaryl-amino, heteroaryl-$C_{1-8}$alkyl-amino, (heteroaryl-$C_{1-8}$alkyl$)_2$-amino, (heteroaryl-$C_{1-8}$alkyl$)(C_{1-8}$alkyl$)$amino, heteroaryl-$C_{1-8}$alkyl-amino-$C_{1-8}$alkyl, (heteroaryl-$C_{1-8}$alkyl$)_2$-amino-$C_{1-8}$alkyl or (heteroaryl-$C_{1-8}$alkyl$)(C_{1-8}$alkyl$)$amino-$C_{1-8}$alkyl; wherein, each instance of heterocyclyl, $C_{3-14}$cycloalkyl, aryl and heteroaryl is optionally substituted with $R_3$ and $R_4$ substituents; and $R_2$ is aryl, aryl-amino, aryl-amino-carbonyl, heterocyclyl, heteroaryl or heteroaryl-amino, wherein, each instance of aryl, heterocyclyl and heteroaryl is optionally substituted with $R_6$ and $R_7$ substituents.

In another embodiment of the use of a compound of Formula (I),

R₁ is heteroaryl optionally substituted with R₃ and R₄ substituents; and

R₂ is aryl, aryl-amino, aryl-amino-carbonyl, heterocyclyl, heteroaryl or heteroaryl-amino, wherein, each instance of aryl, heterocyclyl and heteroaryl is optionally substituted with R₆ and R₇ substituents.

In one embodiment, the compound of Formula (I), used in a method disclosed herein, is a compound selected from Formula (II), Formula (III), Formula (IV), Formula (V), Formula (VI), Formula (VII), Formula (VIII), Formula (IX), Formula (X), Formula (XI), Formula (XII), Formula (XIII) or Formula (XIV):

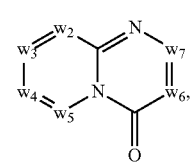
(II)

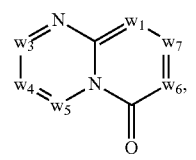
(III)

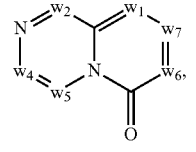
(IV)

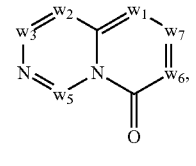
(V)

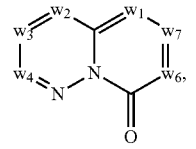
(VI)

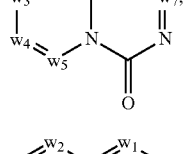
(VII)

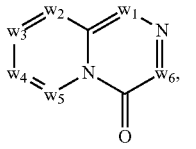
(VIII)

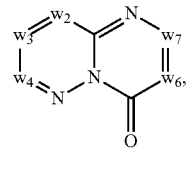
(IX)

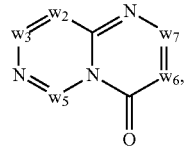
(X)

(XI)

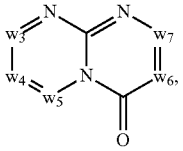
(XII)

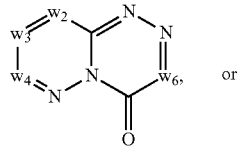
(XIII)

or

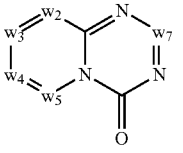
(XIV)

or a form thereof.

In an embodiment of the use of the compound of Formula (I), w₃ is C—R₁, w₆ is C—R₂, w₁, w₄, w₅ and w₇ are independently C—Rₐ or N and w₂ is C—R_b or N.

In another embodiment of the use of the compound of Formula (I), w₃ is C—R₂, w₆ is C—R₁, w₁, w₄, w₅ and w₇ are independently C—Rₐ or N and w₂ is C—R_b or N.

In another embodiment of the use of the compound of Formula (I), w₄ is C—R₁, w₇ is C—R₂, w₁, w₃ and w₅ are independently C—Rₐ or N, w₂ is C—R_b or N and w₆ is C—R_c or N.

In another embodiment of the use of the compound of Formula (I), w₄ is C—R₂, w₇ is C—R₁, w₁, w₃ and w₅ are independently C—Rₐ or N, w₂ is C—R_b or N and w₆ is C—R_c or N.

In an embodiment of the use of the compound of Formula (II), w₃ is C—R₁, w₆ is C—R₂, w₄, w₅ and w₇ are independently C—Rₐ or N and w₂ is C—R_b or N.

In another embodiment of the use of the compound of Formula (II), w₃ is C—R₂, w₆ is C—R₁, w₄, w₅ and w₇ are independently C—Rₐ or N and w₂ is C—R_b or N.

In another embodiment of the use of the compound of Formula (II), w₄ is C—R₁, w₇ is C—R₂, w₃ and w₅ are independently C—Rₐ or N, w₂ is C—R_b or N and w₆ is C—R_c or N.

In another embodiment of the use of the compound of Formula (II), w₄ is C—R₂, w₇ is C—R₁, w₃ and w₅ are independently C—Rₐ or N, w₂ is C—R_b or N and w₆ is C—R_c or N.

In an embodiment of the use of the compound of Formula (III), w₃ is C—R₁, w₆ is C—R₂ and w₁, w₄, w₅ and w₇ are independently C—Rₐ or N.

In another embodiment of the use of the compound of Formula (III), $w_3$ is C—$R_2$, $w_6$ is C—$R_1$ and $w_1$, $w_4$, $w_5$ and $w_7$ are independently C—$R_a$ or N.

In another embodiment of the use of the compound of Formula (III), $w_4$ is C—$R_1$, $w_7$ is C—$R_2$, $w_1$, $w_3$ and $w_5$ are independently C—$R_a$ or N and $w_6$ is C—$R_c$ or N.

In another embodiment of the use of the compound of Formula (III), $w_4$ is C—$R_2$, $w_7$ is C—$R_1$, $w_1$, $w_3$ and $w_5$ are independently C—$R_a$ or N and $w_6$ is C—$R_c$ or N.

In an embodiment of the use of the compound of Formula (IV), $w_4$ is C—$R_1$, $w_7$ is C—$R_2$, $w_1$ and $w_5$ are independently C—$R_a$ or N, $w_2$ is C—$R_b$ or N and $w_6$ is C—$R_c$ or N.

In another embodiment of the use of the compound of Formula (IV), $w_4$ is C—$R_2$, $w_7$ is C—$R_1$, $w_1$ and $w_5$ are independently C—$R_a$ or N, $w_2$ is C—$R_b$ or N and $w_6$ is C—$R_c$ or N.

In an embodiment of the use of the compound of Formula (V), $w_3$ is C—$R_1$, $w_6$ is C—$R_2$, $w_1$, $w_5$ and $w_7$ are independently C—$R_a$ or N and $w_2$ is C—$R_b$ or N.

In another embodiment of the use of the compound of Formula (V), $w_3$ is C—$R_2$, $w_6$ is C—$R_1$, $w_1$, $w_5$ and $w_7$ are independently C—$R_a$ or N and $w_2$ is C—$R_b$ or N.

In an embodiment of the use of the compound of Formula (VI), $w_3$ is C—$R_1$, $w_6$ is C—$R_2$, $w_1$, $w_4$ and $w_7$ are independently C—$R_a$ or N and $w_2$ is C—$R_b$ or N.

In another embodiment of the use of the compound of Formula (VI), $w_3$ is C—$R_2$, $w_6$ is C—$R_1$, $w_1$, $w_4$ and $w_7$ are independently C—$R_a$ or N and $w_2$ is C—$R_b$ or N.

In another embodiment of the use of the compound of Formula (VI), $w_4$ is C—$R_1$, $w_7$ is C—$R_2$, $w_1$ and $w_3$ are independently C—$R_a$ or N, $w_2$ is C—$R_b$ or N and $w_6$ is C—$R_c$ or N.

In another embodiment of the use of the compound of Formula (VI), $w_4$ is C—$R_2$, $w_7$ is C—$R_1$, $w_1$ and $w_3$ are independently C—$R_a$ or N, $w_2$ is C—$R_b$ or N and $w_6$ is C—$R_c$ or N.

In another embodiment of the use of the compound of Formula (VII), $w_4$ is C—$R_1$, $w_7$ is C—$R_2$, $w_1$, $w_3$ and $w_5$ are C—$R_a$ or N and $w_2$ is C—$R_b$ or N.

In another embodiment of the use of the compound of Formula (VII), $w_4$ is C—$R_2$, $w_7$ is C—$R_1$, $w_1$, $w_3$ and $w_5$ are C—$R_a$ or N and $w_2$ is C—$R_b$ or N.

In another embodiment of the use of the compound of Formula (VIII), $w_3$ is C—$R_1$, $w_6$ is C—$R_2$, $w_1$, $w_4$ and $w_5$ are C—$R_a$ or N and $w_2$ is C—$R_b$ or N.

In another embodiment of the use of the compound of Formula (VIII), $w_3$ is C—$R_2$, $w_6$ is C—$R_1$, $w_1$, $w_4$ and $w_5$ are C—$R_a$ or N and $w_2$ is C—$R_b$ or N.

In an embodiment of the use of the compound of Formula (IX), $w_3$ is C—$R_1$, $w_6$ is C—$R_2$, $w_4$ and $w_7$ are independently C—$R_a$ or N and $w_2$ is C—$R_b$ or N.

In another embodiment of the use of the compound of Formula (IX), $w_3$ is C—$R_2$, $w_6$ is C—$R_1$, $w_4$ and $w_7$ are independently C—$R_a$ or N and $w_2$ is C—$R_b$ or N.

In another embodiment of the use of the compound of Formula (IX), $w_4$ is C—$R_1$, $w_7$ is C—$R_2$, $w_2$ is C—$R_b$ or N, $w_3$ is C—$R_a$ or N and $w_6$ is C—$R_c$ or N.

In another embodiment of the use of the compound of Formula (IX), $w_4$ is C—$R_2$, $w_7$ is C—$R_1$, $w_2$ is C—$R_b$ or N, $w_3$ is C—$R_a$ or N and $w_6$ is C—$R_c$ or N.

In an embodiment of the use of the compound of Formula (X), $w_3$ is C—$R_1$, $w_6$ is C—$R_2$, $w_2$ is C—$R_b$ or N and $w_5$ and $w_7$ are independently C—$R_a$ or N.

In another embodiment of the use of the compound of Formula (X), $w_3$ is C—$R_2$, $w_6$ is C—$R_1$, $w_2$ is C—$R_b$ or N and $w_5$ and $w_7$ are independently C—$R_a$ or N.

In an embodiment of the use of the compound of Formula (XI), $w_4$ is C—$R_1$, $w_7$ is C—$R_2$, $w_2$ is C—$R_b$ or N, $w_5$ is C—$R_a$ or N and $w_6$ is C—$R_c$ or N.

In another embodiment of the use of the compound of Formula (XI), $w_4$ is C—$R_2$, $w_7$ is C—$R_1$, $w_2$ is C—$R_b$ or N, $w_5$ is C—$R_a$ or N and $w_6$ is C—$R_c$ or N.

In an embodiment of the use of the compound of Formula (XII), $w_3$ is C—$R_1$, $w_6$ is C—$R_2$ and $w_4$, $w_5$ and $w_7$ are independently C—$R_a$ or N.

In another embodiment of the use of the compound of Formula (XII), $w_3$ is C—$R_2$, $w_6$ is C—$R_1$ and $w_4$, $w_5$ and $w_7$ are independently C—$R_a$ or N.

In another embodiment of the use of the compound of Formula (XII), $w_4$ is C—$R_1$, $w_7$ is C—$R_2$, $w_3$ and $w_5$ are independently C—$R_a$ or N and $w_6$ is C—$R_c$ or N.

In another embodiment of the use of the compound of Formula (XII), $w_4$ is C—$R_2$, $w_7$ is C—$R_1$, $w_3$ and $w_5$ are independently C—$R_a$ or N and $w_6$ is C—$R_c$ or N.

In an embodiment of the use of the compound of Formula (XIII), $w_3$ is C—$R_1$, $w_6$ is C—$R_2$, $w_2$ is C—$R_b$ or N and $w_4$ and $w_5$ are independently C—$R_a$ or N.

In another embodiment of the use of the compound of Formula (XIII), $w_3$ is C—$R_2$, $w_6$ is C—$R_1$, $w_2$ is C—$R_b$ or N and $w_4$ and $w_5$ are independently C—$R_a$ or N.

In an embodiment of the use of the compound of Formula (XIV), $w_4$ is C—$R_1$, $w_7$ is C—$R_2$, $w_2$ is C—$R_b$ or N and $w_3$ and $w_5$ are independently C—$R_a$ or N.

In another embodiment of the use of the compound of Formula (XIV), $w_4$ is C—$R_2$, $w_7$ is C—$R_1$, $w_2$ is C—$R_b$ or N and $w_3$ and $w_5$ are independently C—$R_a$ or N.

In another embodiment, the compound of Formula (I) used in a method disclosed herein is a compound selected from Formula (II), Formula (III), Formula (IX), Formula (XI) or Formula (XII):

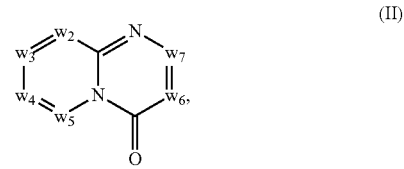

(II)

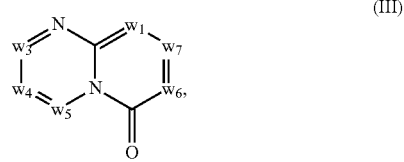

(III)

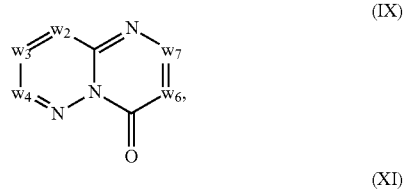

(IX)

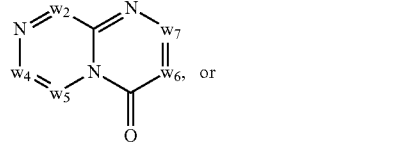

(XI)

(XII)

or a form thereof.
In another embodiment, the compound of Formula (I) used in a method disclosed herein is a compound of Formula (II):

(II)

or a form thereof.
In another embodiment, the compound of Formula (I) used in a method disclosed herein is a compound of Formula (III):

(III)

or a form thereof.
In another embodiment, the compound of Formula (I) used in a method disclosed herein is a compound of Formula (IV):

(IV)

or a form thereof.
In another embodiment, the compound of Formula (I) used in a method disclosed herein is a compound of Formula (V):

(V)

or a form thereof.
In another embodiment, the compound of Formula (I) used in a method disclosed herein is a compound of Formula (VI):

(VI)

or a form thereof.
In another embodiment, the compound of Formula (I) used in a method disclosed herein is a compound of Formula (VII):

(VII)

or a form thereof.
In another embodiment, the compound of Formula (I) used in a method disclosed herein is a compound of Formula (VIII):

(VIII)

or a form thereof.
In another embodiment, the compound of Formula (I) used in a method disclosed herein is a compound of Formula (IX):

(IX)

or a form thereof.
In another embodiment, the compound of Formula (I) used in a method disclosed herein is a compound of Formula (X):

(X)

or a form thereof.
In another embodiment, the compound of Formula (I) used in a method disclosed herein is a compound of Formula (XI):

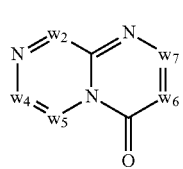
(XI)

or a form thereof.

In another embodiment, the compound of Formula (I) used in a method disclosed herein is a compound of Formula (XII):

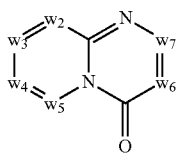
(XII)

or a form thereof.

In another embodiment, the compound of Formula (I) used in a method disclosed herein is a compound of Formula (XIII):

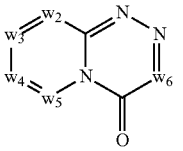
(XIII)

or a form thereof.

In another embodiment, the compound of Formula (I) used in a method disclosed herein is a compound of Formula (XIV):

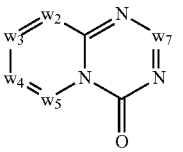
(XIV)

or a form thereof.

In one embodiment, the compound of Formula (I), Formula (II), Formula (III), Formula (IV), Formula (V), Formula (VI), Formula (VII), Formula (VIII), Formula (IX), Formula (X), Formula (XI), Formula (XII), Formula (XIII) or Formula (XIV) used in a method disclosed herein is a compound selected from Formula (Ia), Formula (IIa), Formula (IIIa), Formula (IVa), Formula (Va), Formula (VIa), Formula (VIIa), Formula (VIIIa), Formula (IXa), Formula (Xa), Formula (XIa), Formula (XIIa), Formula (XIIIa) or Formula (XIVa), respectively:

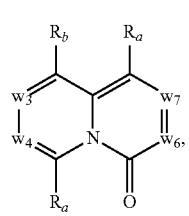
(Ia)

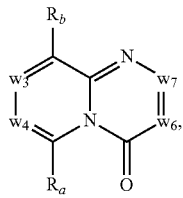
(IIa)

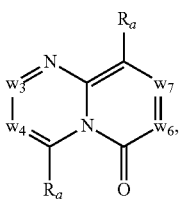
(IIIa)

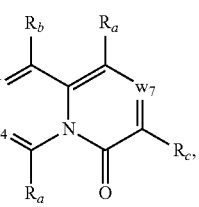
(IVa)

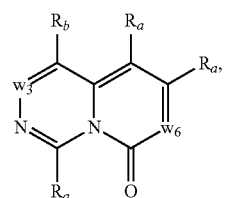
(Va)

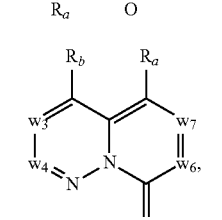
(VIa)

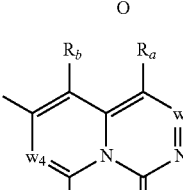
(VIIa)

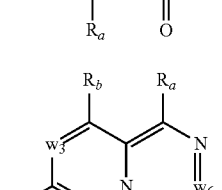
(VIIIa)

-continued (IXa)

(Xa)

(XIa)

(XIIa)

(XIIIa)

(XIVa)

or a form thereof.

In an embodiment of the use of the compound of Formula (Ia), one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N.

In an embodiment of the use of the compound of Formula (IIa), one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N.

In an embodiment of the use of the compound of Formula (IIIa), one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N.

In an embodiment of the use of the compound of Formula (IVa), one of $w_4$ and $w_7$ is C—$R_1$ and the other is C—$R_2$, provided that, when $w_4$ is C—$R_1$, then $w_7$ is C—$R_2$; or, when $w_4$ is C—$R_2$, then $w_7$ is C—$R_1$.

In an embodiment of the use of the compound of Formula (Va), one of $w_3$ and $w_6$ is C—$R_1$ and the other is C—$R_2$, provided that, when $w_3$ is C—$R_1$, then $w_6$ is C—$R_2$; or, when $w_3$ is C—$R_2$, then $w_6$ is C—$R_1$.

In an embodiment of the use of the compound of Formula (VIa), one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N.

In an embodiment of the use of the compound of Formula (VIIa), one of $w_4$ and $w_7$ is C—$R_1$ and the other is C—$R_2$, provided that, when $w_4$ is C—$R_1$, then $w_7$ is C—$R_2$; or, when $w_4$ is C—$R_2$, then $w_7$ is C—$R_1$.

In an embodiment of the use of the compound of Formula (VIIIa), one of $w_3$ and $w_6$ is C—$R_1$ and the other is C—$R_2$, provided that, when $w_3$ is C—$R_1$, then $w_6$ is C—$R_2$; or, when $w_3$ is C—$R_2$, then $w_6$ is C—$R_1$.

In an embodiment of the use of the compound of Formula (IXa), one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N.

In an embodiment of the use of the compound of Formula (Xa), one of $w_3$ and $w_6$ is C—$R_1$ and the other is C—$R_2$, provided that, when $w_3$ is C—$R_1$, then $w_6$ is C—$R_2$; or, when $w_3$ is C—$R_2$, then $w_6$ is C—$R_1$.

In an embodiment of the use of the compound of Formula (XIa), one of $w_4$ and $w_7$ is C—$R_1$ and the other is C—$R_2$, provided that, when $w_4$ is C—$R_1$, then $w_7$ is C—$R_2$; or, when $w_4$ is C—$R_2$, then $w_7$ is C—$R_1$.

In an embodiment of the use of the compound of Formula (XIIa), one of $w_3$, $w_4$, $w_6$ and $w_7$ is C—$R_1$ and one other of $w_3$, $w_4$, $w_6$ and $w_7$ is C—$R_2$, provided that, when $w_3$ is C—$R_1$, then $w_6$ is C—$R_2$ and $w_4$ and $w_7$ are independently C—$R_a$ or N; or, when $w_3$ is C—$R_2$, then $w_6$ is C—$R_1$ and $w_4$ and $w_7$ are independently C—$R_a$ or N; or, when $w_4$ is C—$R_1$, then $w_7$ is C—$R_2$ and $w_3$ is C—$R_a$ or N and $w_6$ is C—$R_c$ or N; or, when $w_4$ is C—$R_2$, then $w_7$ is C—$R_1$ and $w_3$ is C—$R_a$ or N and $w_6$ is C—$R_c$ or N.

In an embodiment of the use of the compound of Formula (XIIIa), one of $w_3$ and $w_6$ is C—$R_1$ and the other is C—$R_2$, provided that, when $w_3$ is C—$R_1$, then $w_6$ is C—$R_2$; or, when $w_3$ is C—$R_2$, then $w_6$ is C—$R_1$.

In an embodiment of the use of the compound of Formula (XIVa), one of $w_4$ and $w_7$ is C—$R_1$ and the other is C—$R_2$, provided that, when $w_4$ is C—$R_1$, then $w_7$ is C—$R_2$; or, when $w_4$ is C—$R_2$, then $w_7$ is C—$R_1$.

In another embodiment, the compound of Formula (I), Formula (II), Formula (III), Formula (IX), Formula (XI) or Formula (XII), used in a method disclosed herein, is a compound selected from Formula (Ia), Formula (IIa), Formula (IIIa), Formula (IXa), Formula (XIa) or Formula (XIIa), respectively:

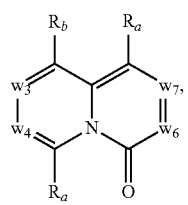

(Ia)

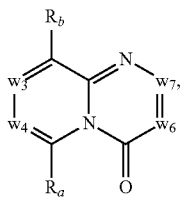

(IIa)

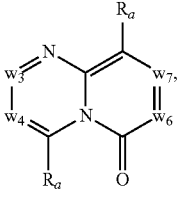

(IIIa)

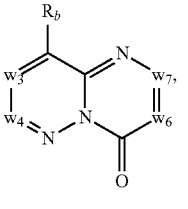

(XIa)

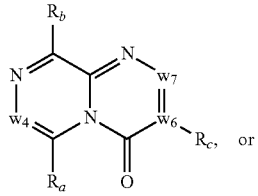

or

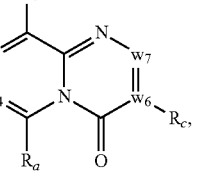

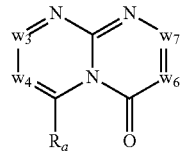

(XIIa)

or a form thereof.

In another embodiment, the compound of Formula (I) used in a method disclosed herein is a compound of Formula (Ia):

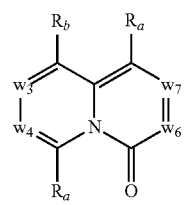

(Ia)

or a form thereof.

In another embodiment, the compound of Formula (II) used in a method disclosed herein is a compound of Formula (IIa):

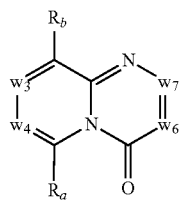

(IIa)

or a form thereof.

In another embodiment, the compound of Formula (III) used in a method disclosed herein is a compound of Formula (IIIa):

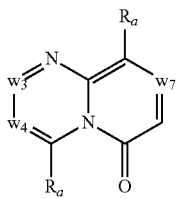

(IIIa)

or a form thereof.

In another embodiment, the compound of Formula (IV) used in a method disclosed herein is a compound of Formula (IVa):

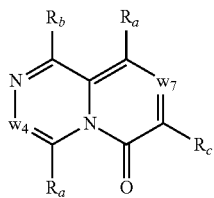
(IVa)

or a form thereof.

In another embodiment, the compound of Formula (V) used in a method disclosed herein is a compound of Formula (Va):

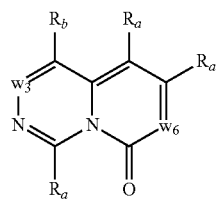
(Va)

or a form thereof.

In another embodiment, the compound of Formula (VI) used in a method disclosed herein is a compound of Formula (VIa):

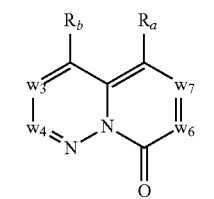
(VIa)

or a form thereof.

In another embodiment, the compound of Formula (VII) used in a method disclosed herein is a compound of Formula (VIIa):

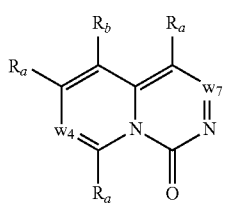
(VIIa)

or a form thereof.

In another embodiment, the compound of Formula (VIII) used in a method disclosed herein is a compound of Formula (VIIIa):

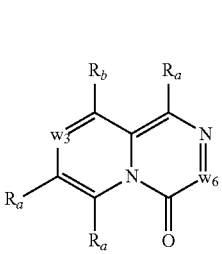
(VIIIa)

or a form thereof.

In another embodiment, the compound of Formula (IX) used in a method disclosed herein is a compound of Formula (IXa):

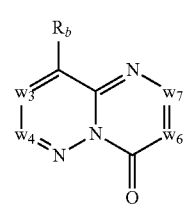
(IXa)

or a form thereof.

In another embodiment, the compound of Formula (X) used in a method disclosed herein is a compound of Formula (Xa):

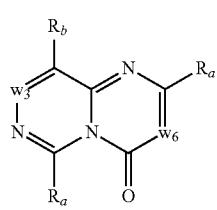
(Xa)

or a form thereof.

In another embodiment, the compound of Formula (XI) used in a method disclosed herein is a compound of Formula (XIa):

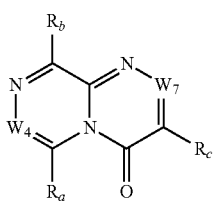
(XIa)

or a form thereof.

In another embodiment, the compound of Formula (XII) used in a method disclosed herein is a compound of Formula (XIIa):

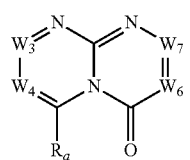

(XIIa)

or a form thereof.

In another embodiment, the compound of Formula (XIII) used in a method disclosed herein is a compound of Formula (XIIIa):

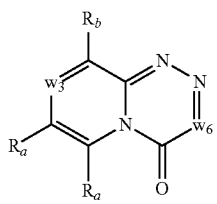

(XIIIa)

or a form thereof.

In another embodiment, the compound of Formula (XIV) used in a method disclosed herein is a compound of Formula (XIVa):

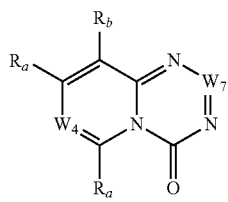

(XIVa)

or a form thereof.

In one embodiment, the compound of Formula (Ia) used in a method disclosed herein is a compound of Formula (Ia1), Formula (Ia2), Formula (Ia3) or Formula (Ia4):

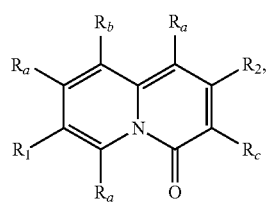

(Ia1)

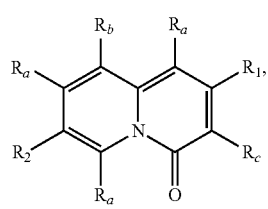

(Ia2)

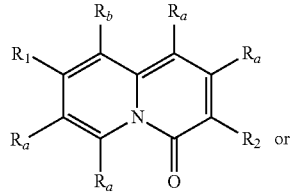

(Ia3)

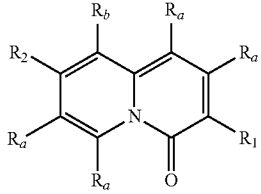

(Ia4)

or a form thereof.

In one embodiment, the compound of Formula (IIa) used in a method disclosed herein is a compound of Formula (IIa1), Formula (IIa2), Formula (IIa3) or Formula (IIa4):

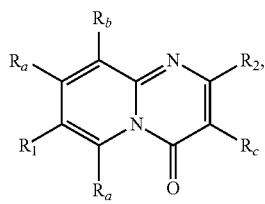

(IIa1)

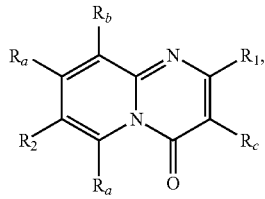

(IIa2)

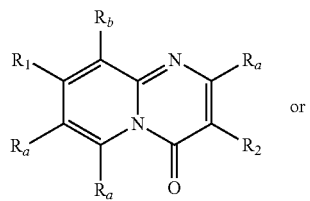

(IIa3)

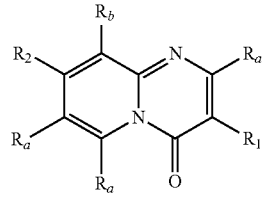

(IIa4)

or a form thereof.

In one embodiment, the compound of Formula (IIIa) used in a method disclosed herein is a compound of Formula (IIIa1), Formula (IIIa2), Formula (IIIa3) or Formula (IIIa4):

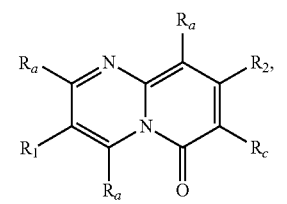
(IIIa1)

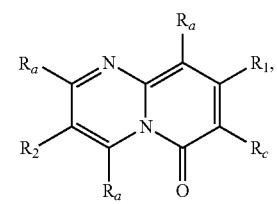
(IIIa2)

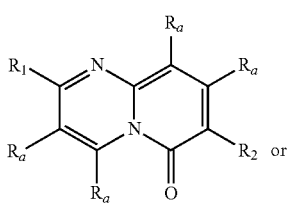
(IIIa3) or

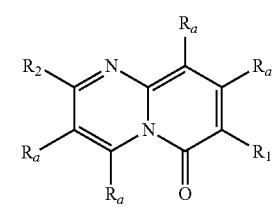
(IIIa4)

or a form thereof.

In one embodiment, the compound of Formula (IVa) used in a method disclosed herein is a compound of Formula (IVa1) or Formula (IVa2):

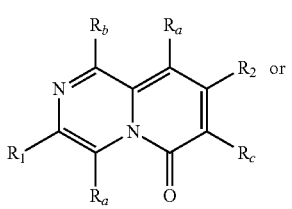
(IVa1) or

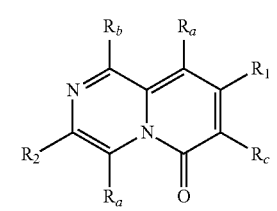
(IVa2)

or a form thereof.

In one embodiment, the compound of Formula (Va) used in a method disclosed herein is a compound of Formula (Va1) or Formula (Va2):

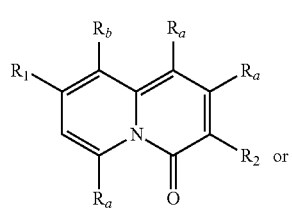
(Va1)

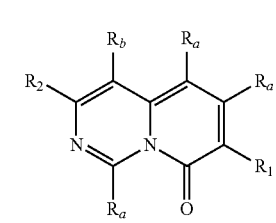
(Va2)

or a form thereof.

In one embodiment, the compound of Formula (VIa) used in a method disclosed herein is a compound of Formula (VIa1), Formula (VIa2), Formula (VIa3) or Formula (VIa4):

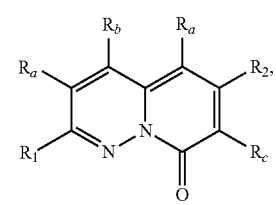
(VIa1)

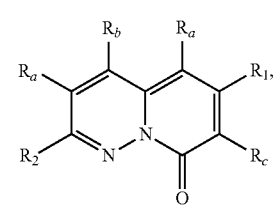
(VIa2)

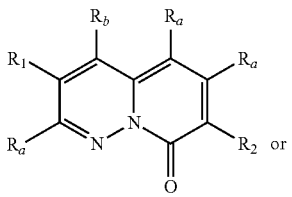
(VIa3) or

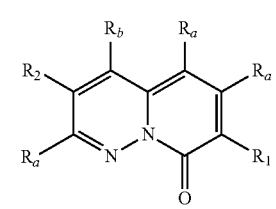
(VIa4)

or a form thereof.

In one embodiment, the compound of Formula (VIIa) used in a method disclosed herein is a compound of Formula (VIIa1) or Formula (VIIa2):

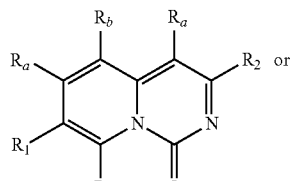
(VIIa1)

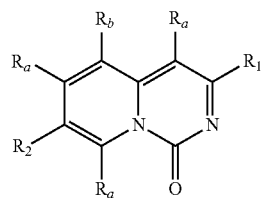
(VIIa2)

or a form thereof.

In one embodiment, the compound of Formula (VIIIa) used in a method disclosed herein is a compound of Formula (VIIIa1) or Formula (VIIIa2):

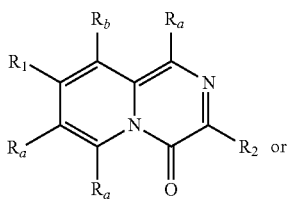
(VIIIa1)

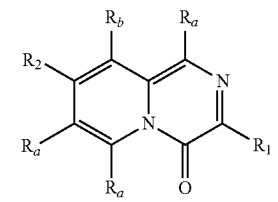
(VIIIa2)

or a form thereof.

In one embodiment, the compound of Formula (IXa) used in a method disclosed herein is a compound of Formula (IXa1), Formula (IXa2), Formula (IXa3) or Formula (IXa4):

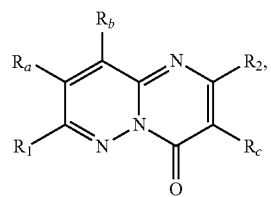
(IXa1)

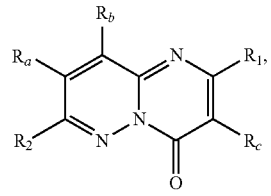
(IXa2)

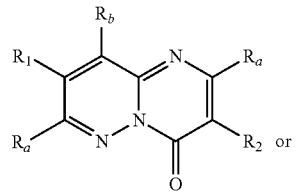
(IXa3)

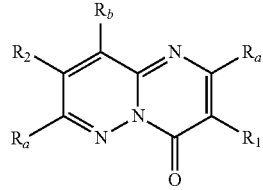
(IXa4)

or a form thereof.

In one embodiment, the compound of Formula (Xa) used in a method disclosed herein is a compound of Formula (Xa1) or Formula (Xa2):

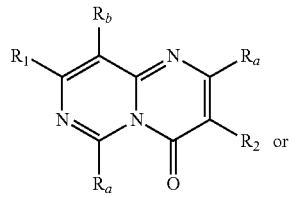
(Xa1)

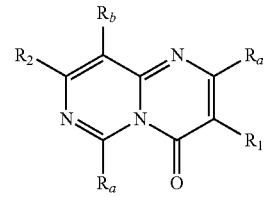
(Xa2)

or a form thereof.

In one embodiment, the compound of Formula (XIa) used in a method disclosed herein is a compound of Formula (XIa1) or Formula (XIa2):

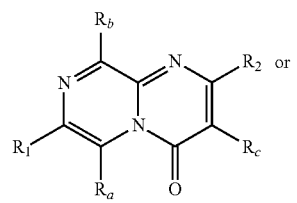
(XIa1)

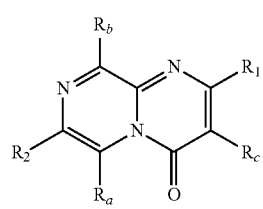
(XIa2)

or a form thereof.

In one embodiment, the compound of Formula (XIIa) used in a method disclosed herein is a compound of Formula (XIIa1), Formula (XIIa2), Formula (XIIa3) or Formula (XIIa4):

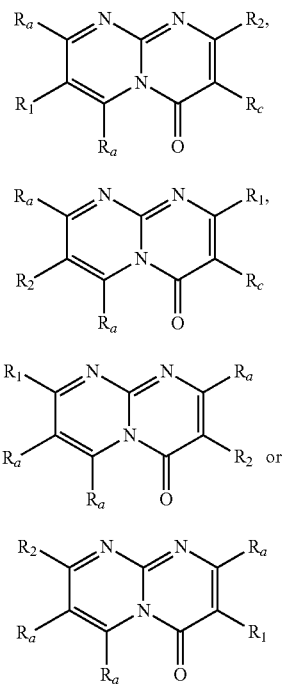

or a form thereof.

In one embodiment, the compound of Formula (XIIIa) used in a method disclosed herein is a compound of Formula (XIIIa1) or Formula (XIIIa2):

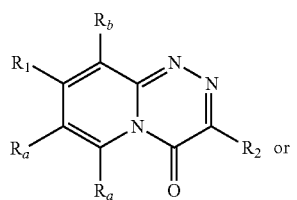

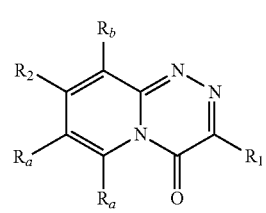

or a form thereof.

In one embodiment, the compound of Formula (XIVa) used in a method disclosed herein is a compound of Formula (XIVa1) or Formula (XIVa2):

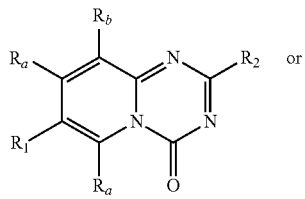

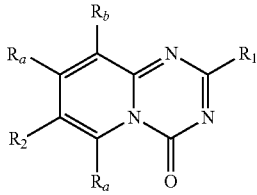

or a form thereof.

In one embodiment, the compound of Formula (Ia) used in a method disclosed herein is a compound of Formula (Ia1):

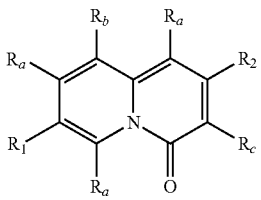

or a form thereof.

In one embodiment, the compound of Formula (Ia) used in a method disclosed herein is a compound of Formula (Ia2):

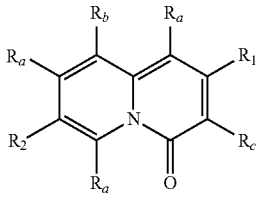

or a form thereof.

In one embodiment, the compound of Formula (Ia) used in a method disclosed herein is a compound of Formula (Ia3):

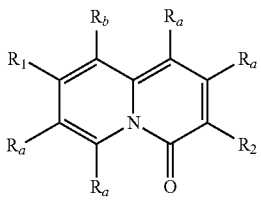

or a form thereof.

In one embodiment, the compound of Formula (Ia) used in a method disclosed herein is a compound of Formula (Ia4):

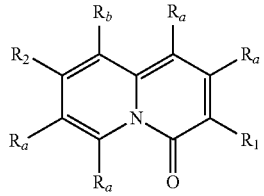

(Ia4)

or a form thereof.

In one embodiment, the compound of Formula (IIa) used in a method disclosed herein is a compound of Formula (IIa1):

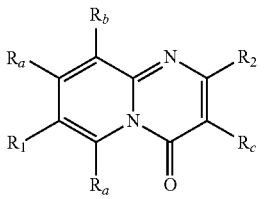

(IIa1)

or a form thereof.

In one embodiment, the compound of Formula (IIa) used in a method disclosed herein is a compound of Formula (IIa2):

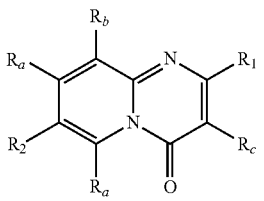

(IIa2)

or a form thereof.

In one embodiment, the compound of Formula (IIa) used in a method disclosed herein is a compound of Formula (IIa3):

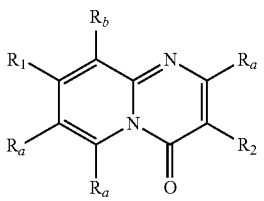

(IIa3)

or a form thereof.

In one embodiment, the compound of Formula (IIa) used in a method disclosed herein is a compound of Formula (IIa4):

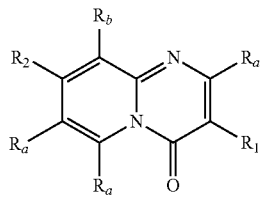

(IIa4)

or a form thereof.

In one embodiment, the compound of Formula (IIIa) used in a method disclosed herein is a compound of Formula (IIIa1):

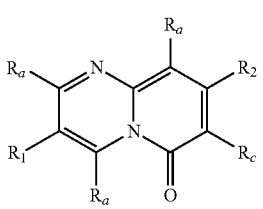

(IIIa1)

or a form thereof.

In one embodiment, the compound of Formula (IIIa) used in a method disclosed herein is a compound of Formula (IIIa2):

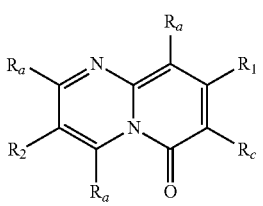

(IIIa2)

or a form thereof.

In one embodiment, the compound of Formula (IIIa) used in a method disclosed herein is a compound of Formula (IIIa3):

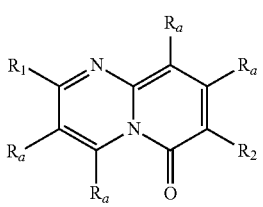

(IIIa3)

or a form thereof.

In one embodiment, the compound of Formula (IIIa) used in a method disclosed herein is a compound of Formula (IIIa4):

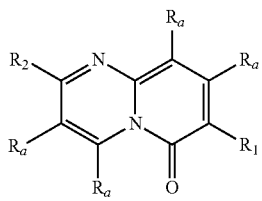

(IIIa4)

or a form thereof.

In one embodiment, the compound of Formula (IVa) used in a method disclosed herein is a compound of Formula (IVa1):

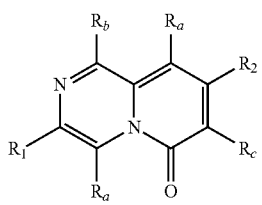

(IVa1)

or a form thereof.

In one embodiment, the compound of Formula (IVa) used in a method disclosed herein is a compound of Formula (IVa2):

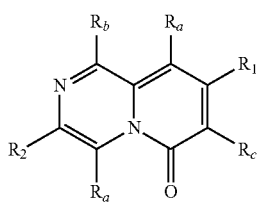

(IVa2)

or a form thereof.

In one embodiment, the compound of Formula (Va) used in a method disclosed herein is a compound of Formula (Va1):

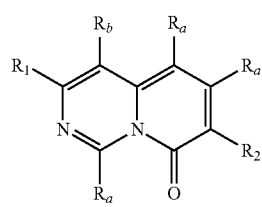

(Va1)

or a form thereof.

In one embodiment, the compound of Formula (Va) used in a method disclosed herein is a compound of Formula (Va2):

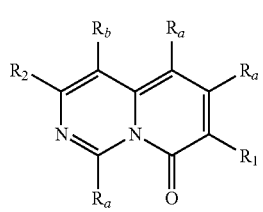

(Va2)

or a form thereof.

In one embodiment, the compound of Formula (VIa) used in a method disclosed herein is a compound of Formula (VIa1):

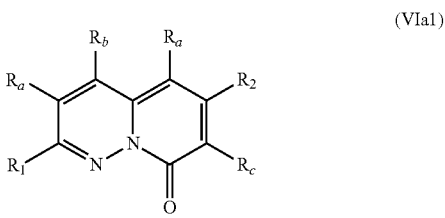

(VIa1)

or a form thereof.

In one embodiment, the compound of Formula (VIa) used in a method disclosed herein is a compound of Formula (VIa2):

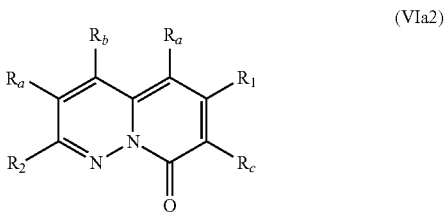

(VIa2)

or a form thereof.

In one embodiment, the compound of Formula (VIa) used in a method disclosed herein is a compound of Formula (VIa3):

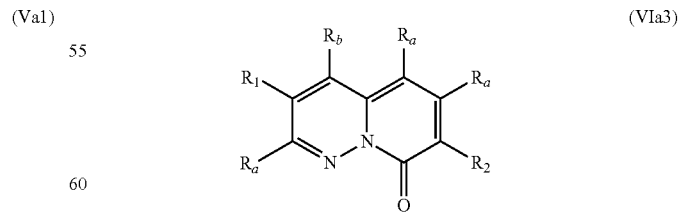

(VIa3)

or a form thereof.

In one embodiment, the compound of Formula (VIa) used in a method disclosed herein is a compound of Formula (VIa4):

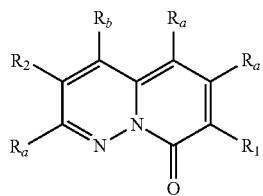
(VIa4)

or a form thereof.

In one embodiment, the compound of Formula (VIIa) used in a method disclosed herein is a compound of Formula (VIIa1):

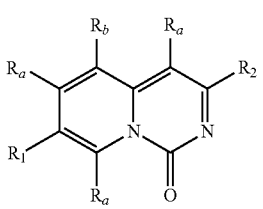
(VIIa1)

or a form thereof.

In one embodiment, the compound of Formula (VIIa) used in a method disclosed herein is a compound of Formula (VIIa2):

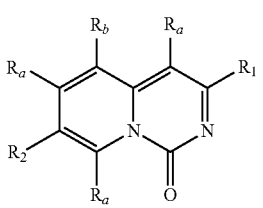
(VIIa2)

or a form thereof.

In one embodiment, the compound of Formula (VIIIa) used in a method disclosed herein is a compound of Formula (VIIIa1):

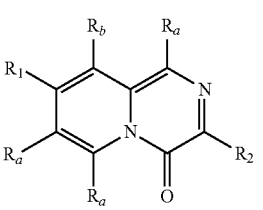
(VIIIa1)

or a form thereof.

In one embodiment, the compound of Formula (VIIIa) used in a method disclosed herein is a compound of Formula (VIIIa2):

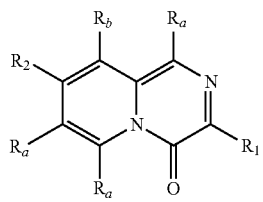
(VIIIa2)

or a form thereof.

In one embodiment, the compound of Formula (IXa) used in a method disclosed herein is a compound of Formula (IXa1):

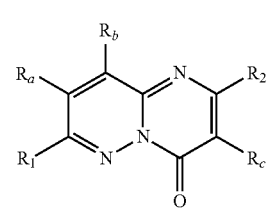
(IXa1)

or a form thereof.

In one embodiment, the compound of Formula (IXa) used in a method disclosed herein is a compound of Formula (IXa2):

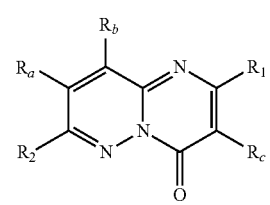
(IXa2)

or a form thereof.

In one embodiment, the compound of Formula (IXa) used in a method disclosed herein is a compound of Formula (IXa3):

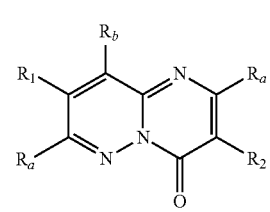
(IXa3)

or a form thereof.

In one embodiment, the compound of Formula (IXa) used in a method disclosed herein is a compound of Formula (IXa4):

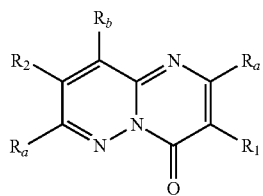
(IXa4)

or a form thereof.

In one embodiment, the compound of Formula (Xa) used in a method disclosed herein is a compound of Formula (Xa1):

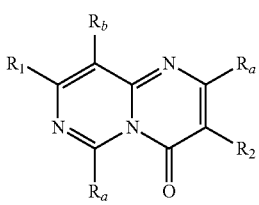
(Xa1)

or a form thereof.

In one embodiment, the compound of Formula (Xa) used in a method disclosed herein is a compound of Formula (Xa2):

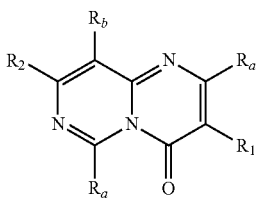
(Xa2)

or a form thereof.

In one embodiment, the compound of Formula (XIa) used in a method disclosed herein is a compound of Formula (XIa1):

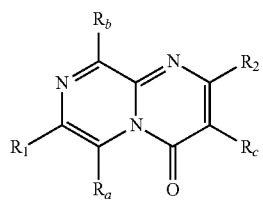
(XIa1)

or a form thereof.

In one embodiment, the compound of Formula (XIa) used in a method disclosed herein is a compound of Formula (XIa2):

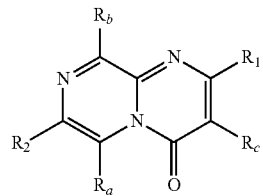
(XIa2)

or a form thereof.

In one embodiment, the compound of Formula (XIIa) used in a method disclosed herein is a compound of Formula (XIIa1):

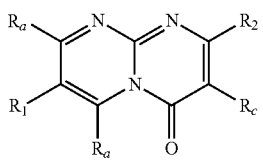
(XIIa1)

or a form thereof.

In one embodiment, the compound of Formula (XIIa) used in a method disclosed herein is a compound of Formula (XIIa2):

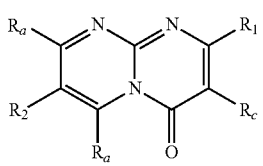
(XIIa2)

or a form thereof.

In one embodiment, the compound of Formula (XIIa) used in a method disclosed herein is a compound of Formula (XIIa3):

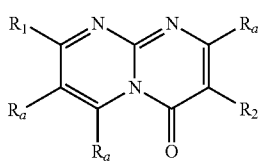
(XIIa3)

or a form thereof.

In one embodiment, the compound of Formula (XIIa) used in a method disclosed herein is a compound of Formula (XIIa4):

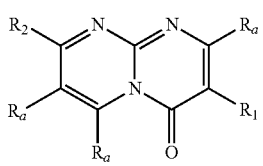
(XIIa4)

or a form thereof.

In one embodiment, the compound of Formula (XIIIa) used in a method disclosed herein is a compound of Formula (XIIIa1):

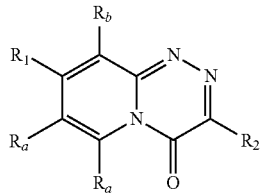

(XIIIa1)

or a form thereof.

In one embodiment, the compound of Formula (XIIIa) used in a method disclosed herein is a compound of Formula (XIIIa2):

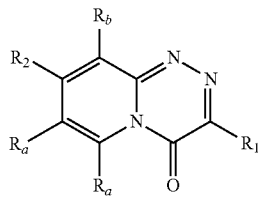

(XIIIa2)

or a form thereof.

In one embodiment, the compound of Formula (XIVa) used in a method disclosed herein is a compound of Formula (XIVa1):

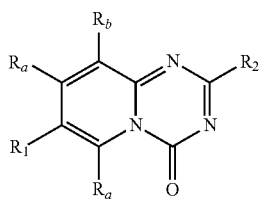

(XIVa1)

or a form thereof.

In one embodiment, the compound of Formula (XIVa) used in a method disclosed herein is a compound of Formula (XIVa2):

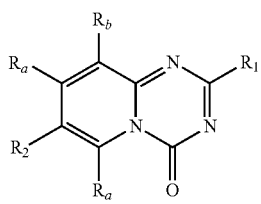

(XIVa2)

or a form thereof.

In another embodiment, the compound of Formula (I) used in a method disclosed herein is a compound selected from the group consisting of:

1

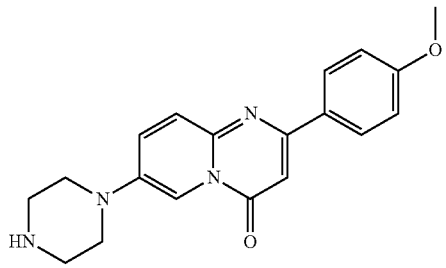

2

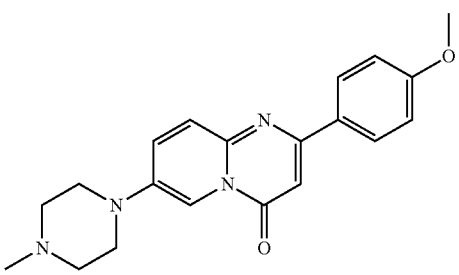

3

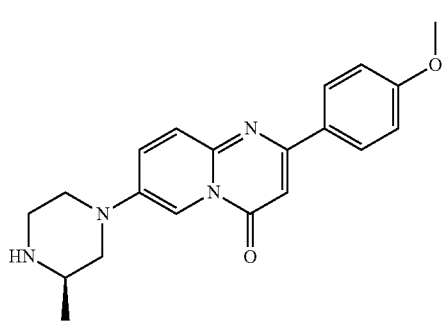

4

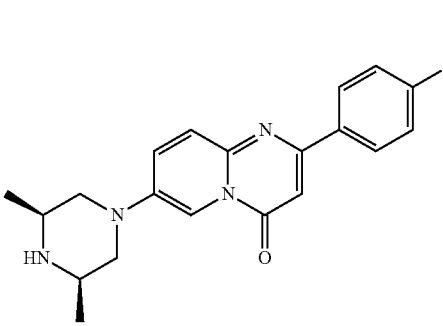

5

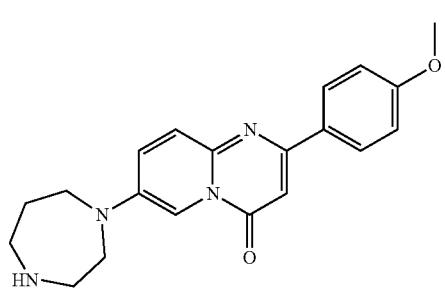

6
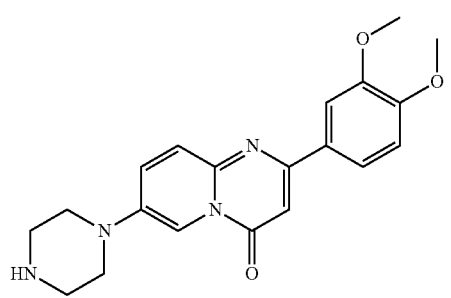
7
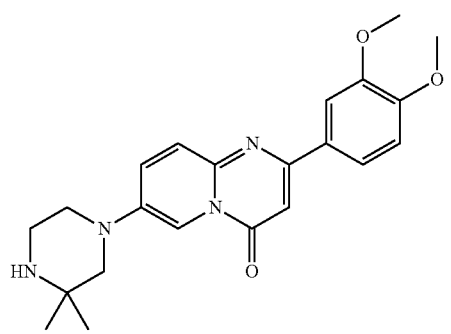
8
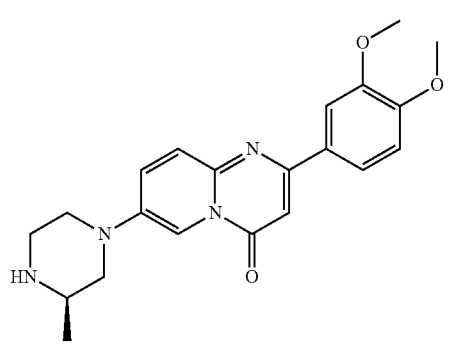
9
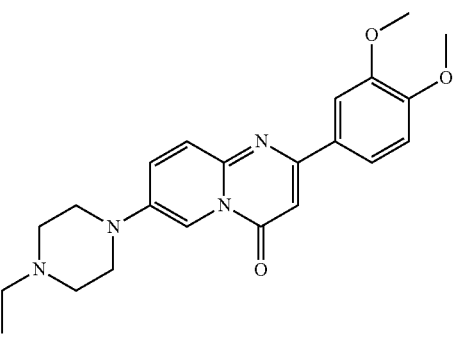
10
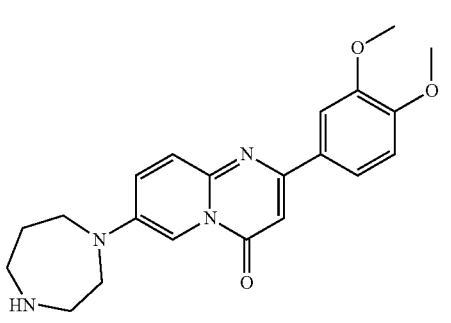
11
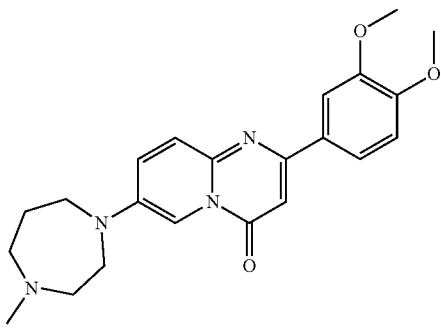
12
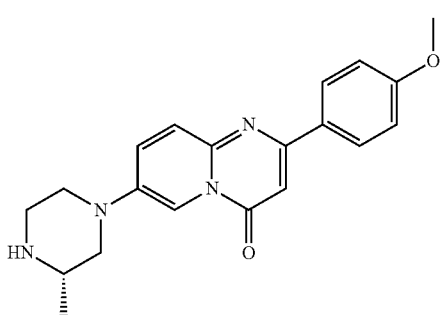
13
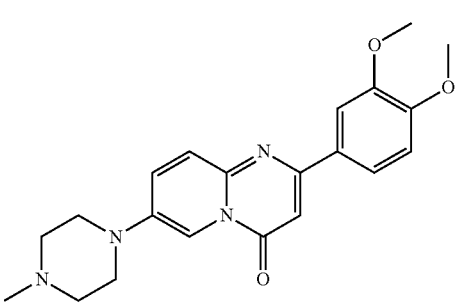
14
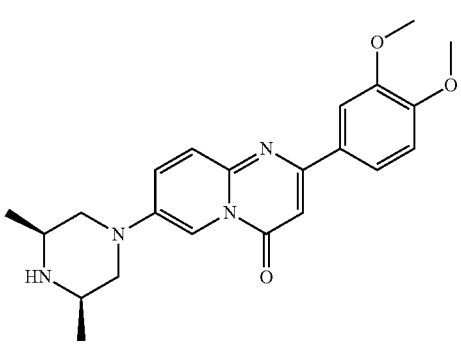
15
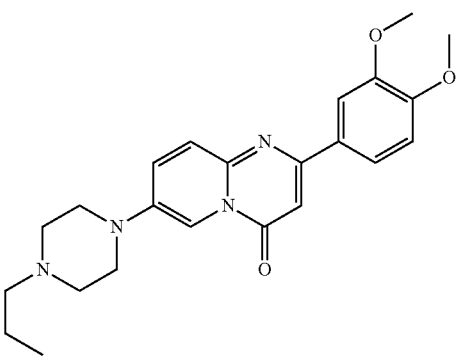

233
-continued
16
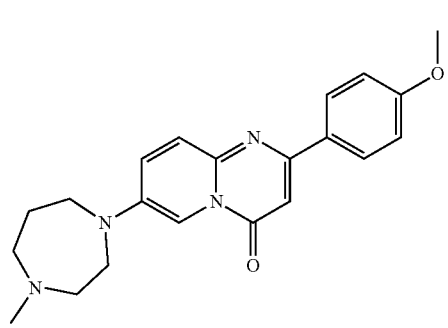
17
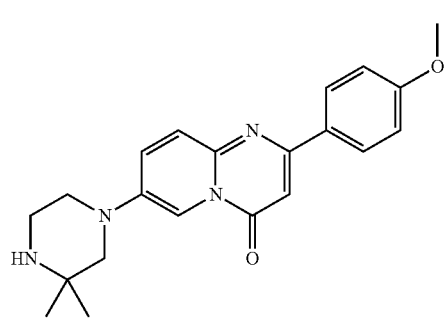
18
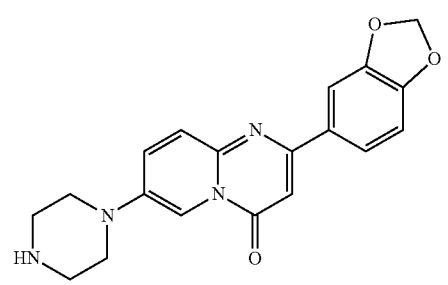
19
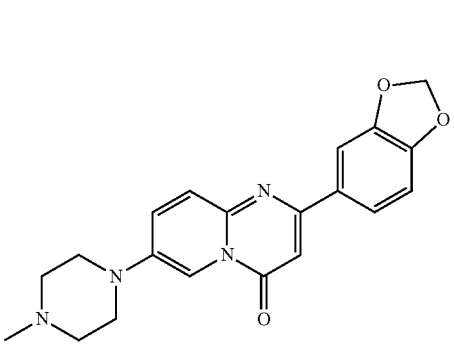
20
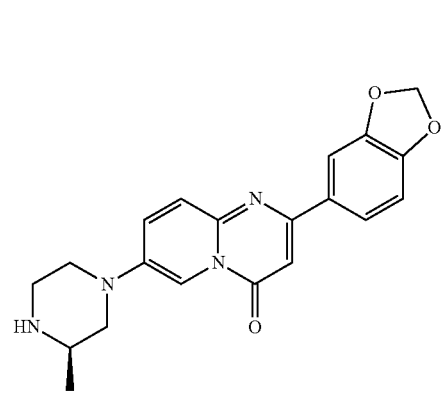
234
-continued
21
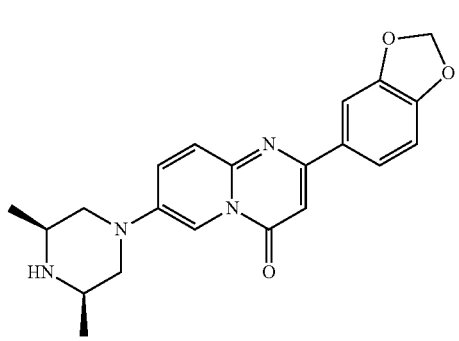
22
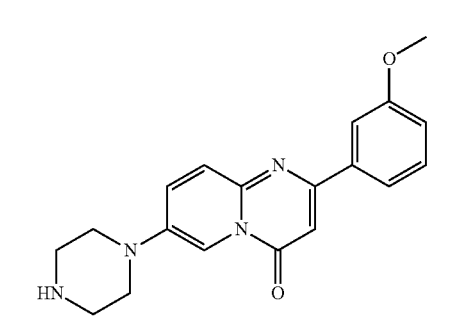
23
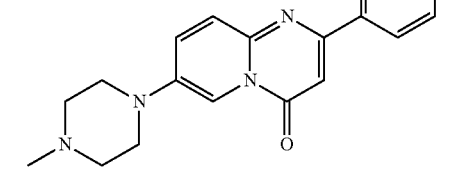
24
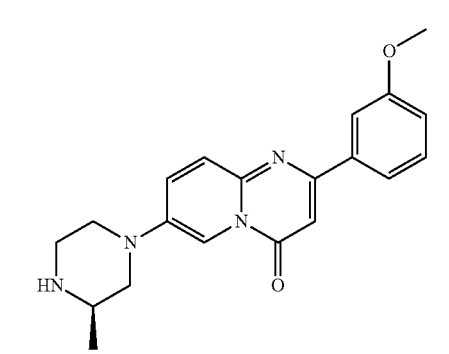
25
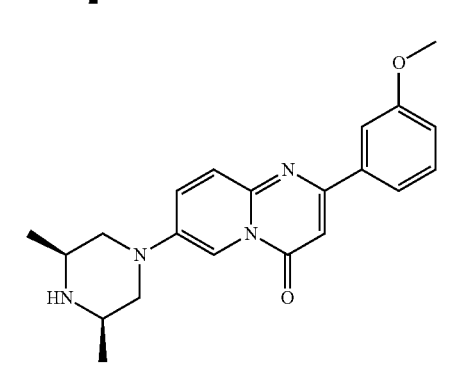

26
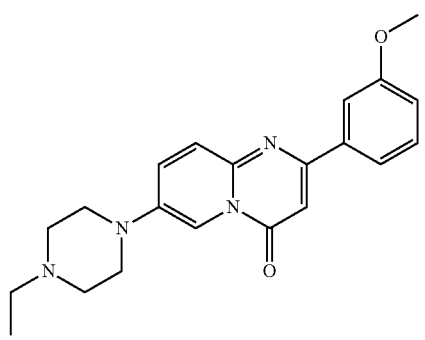
27
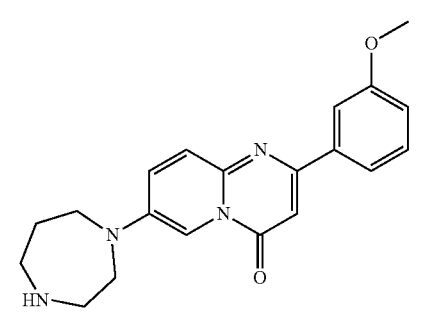
28
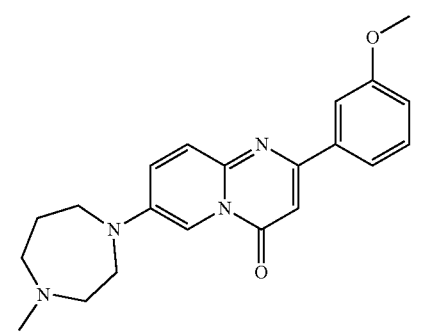
29
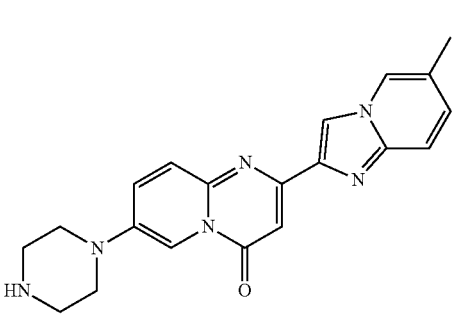
30
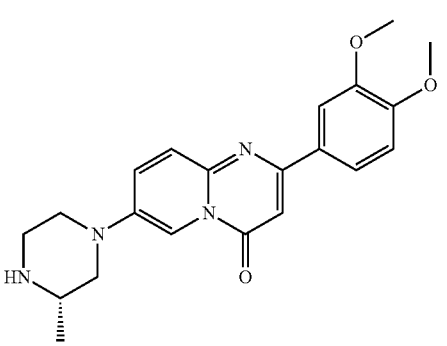
31
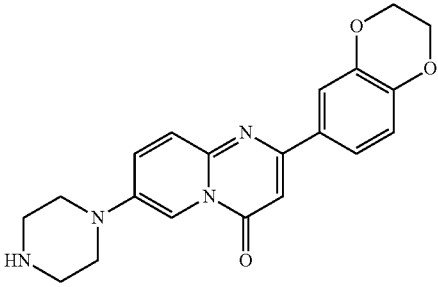
32
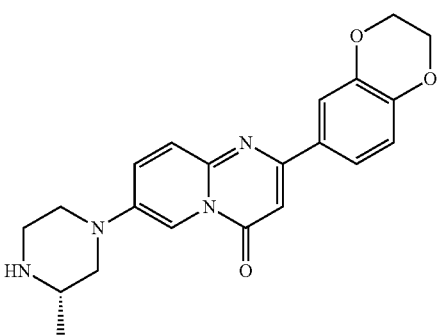
33
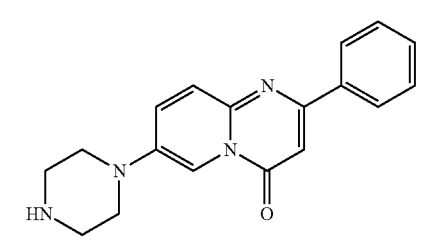
34
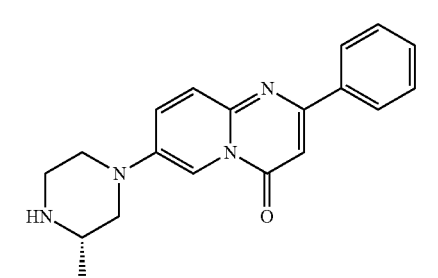
35
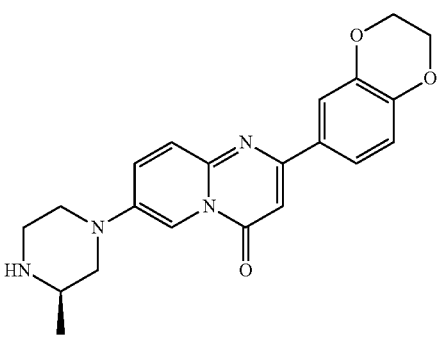

-continued
36
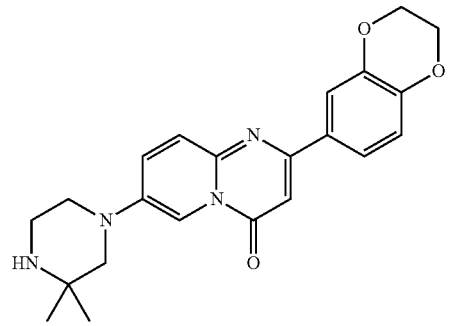
37
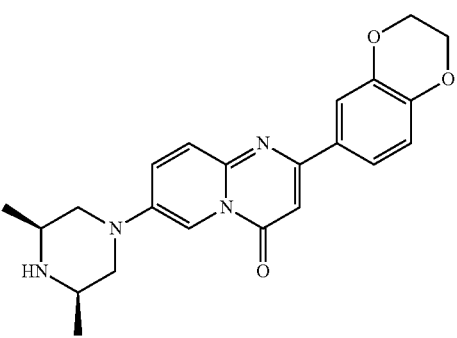
38
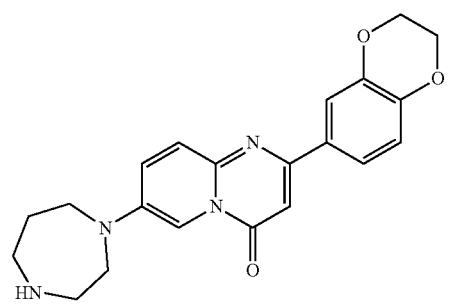
39
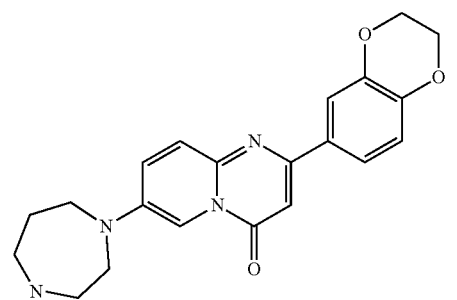
40
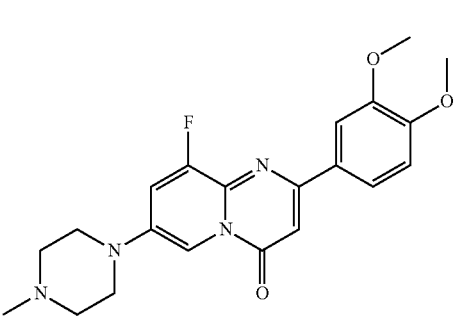
-continued
41
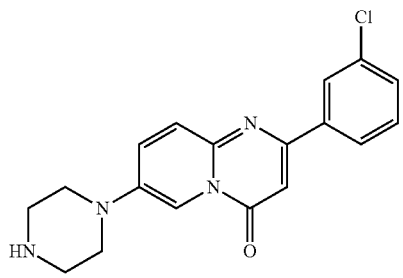
42
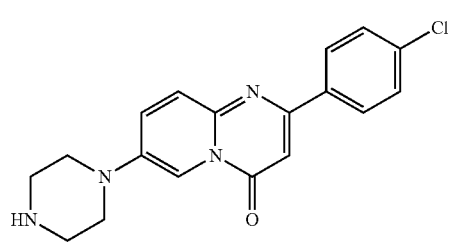
43
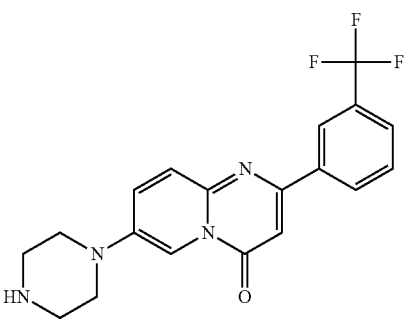
44
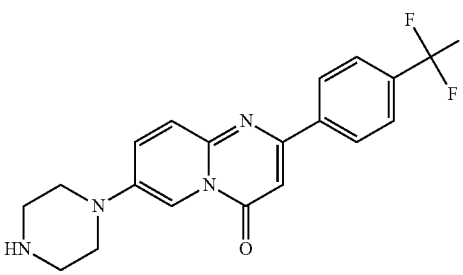
45
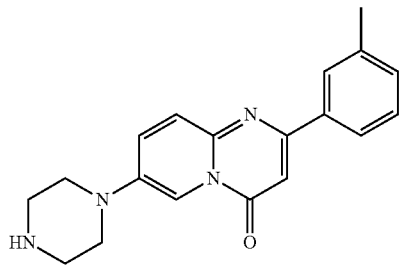
46
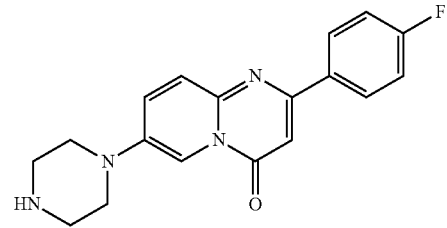

47
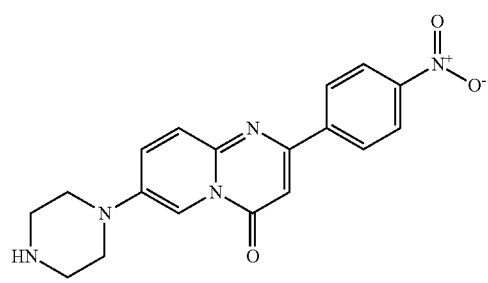
48
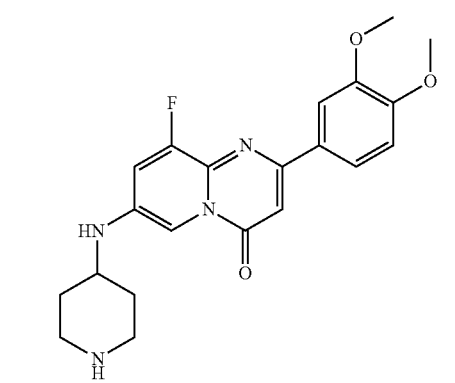
49
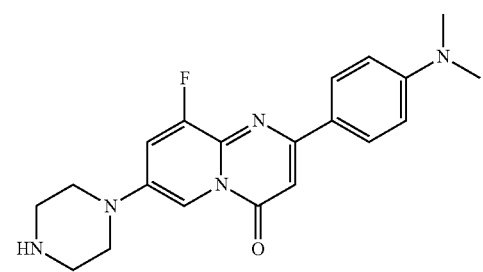
50
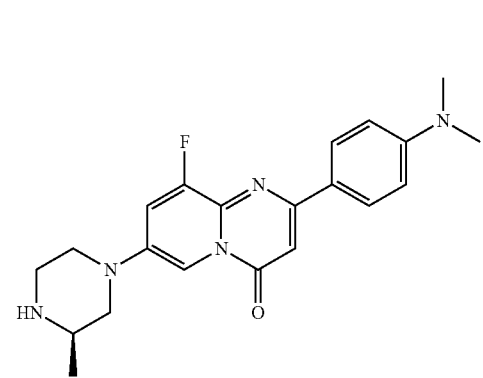
51
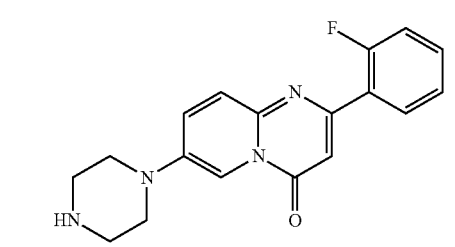
52
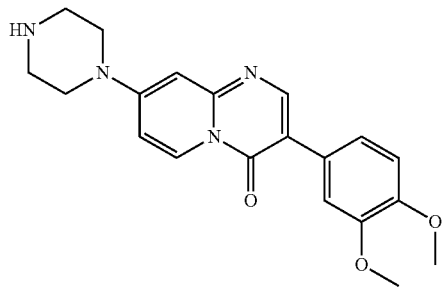
53
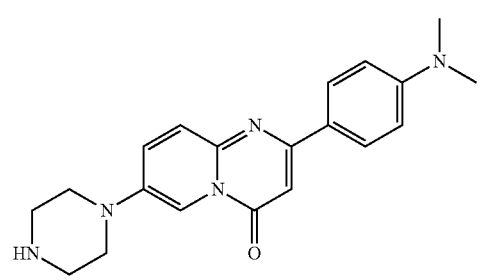
54
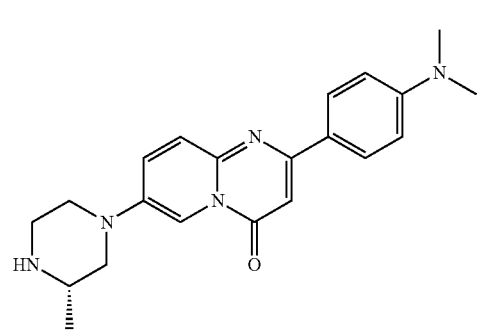
55
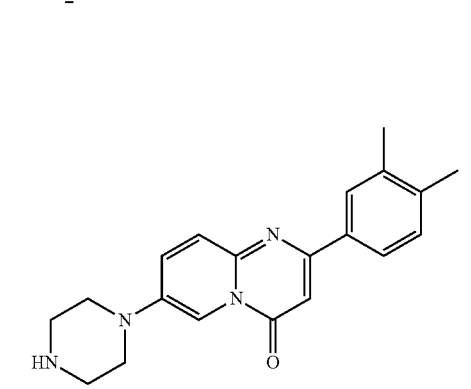
56
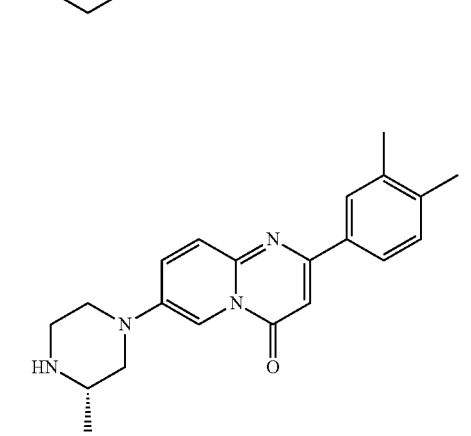

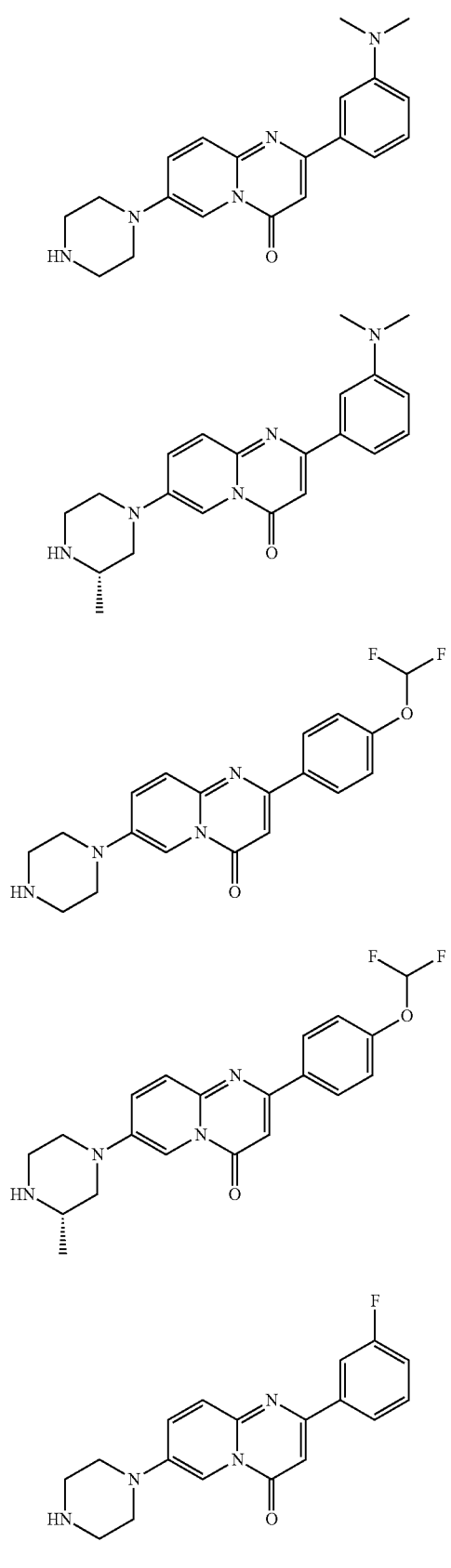
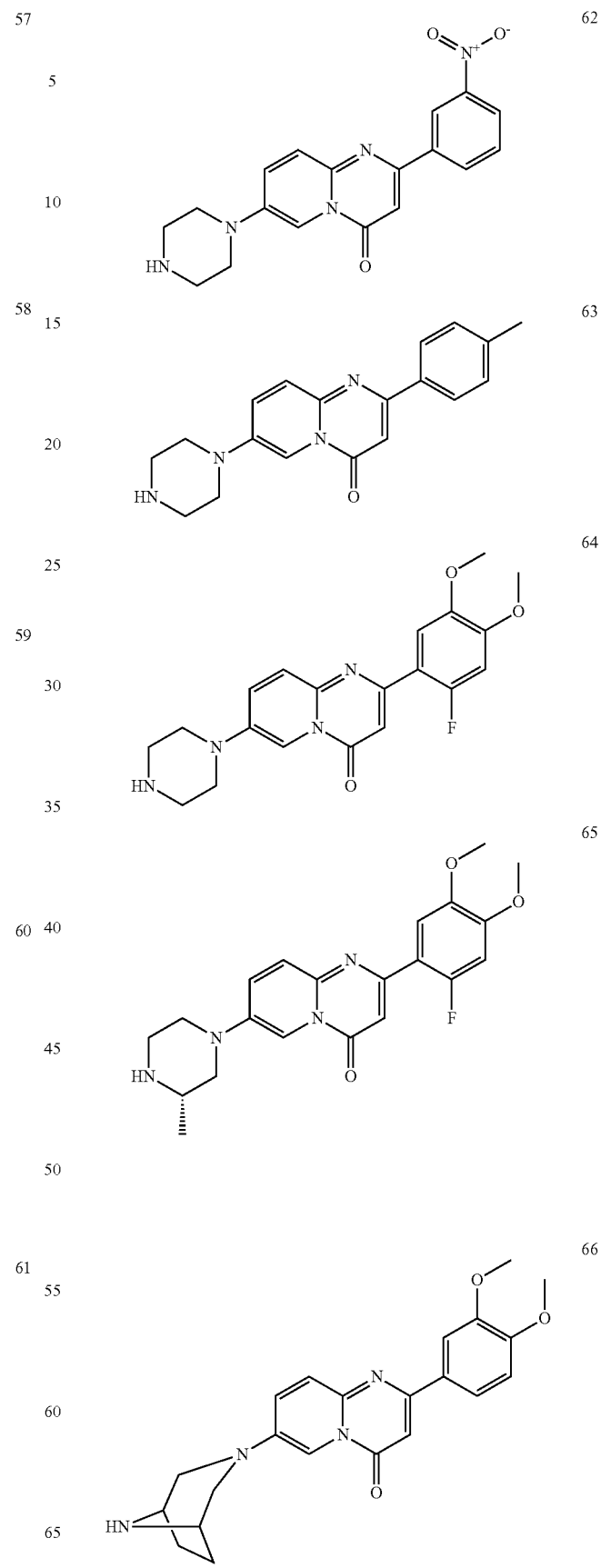

67
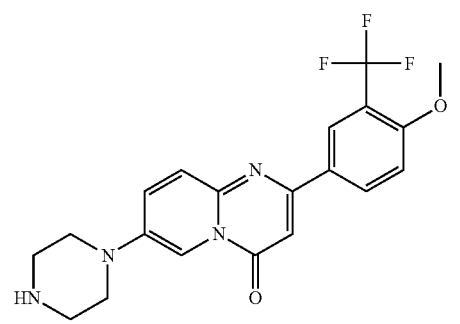
68
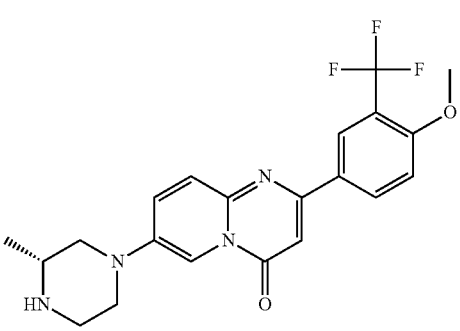
69
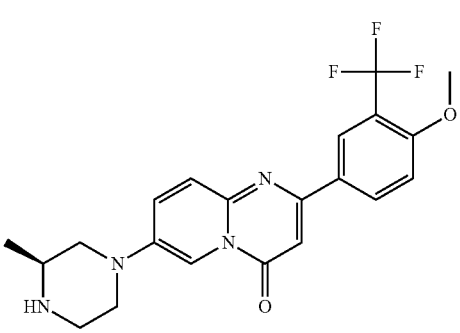
70
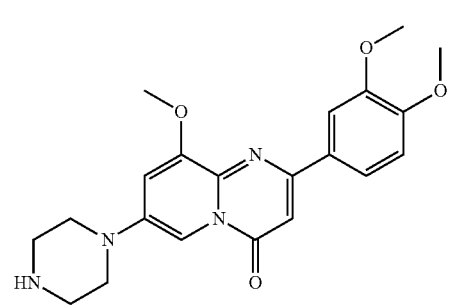
71
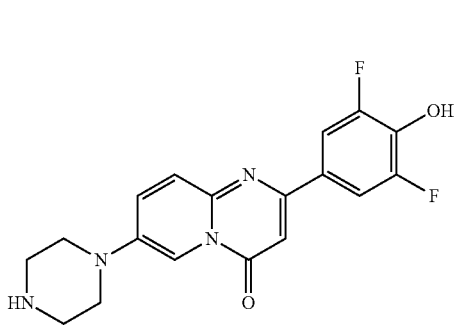
72
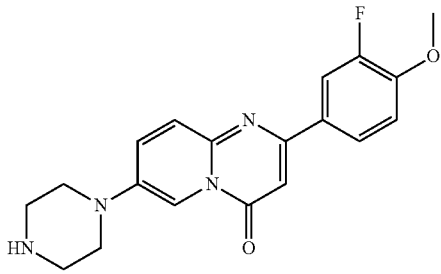
73
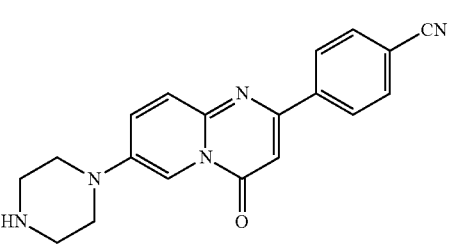
74
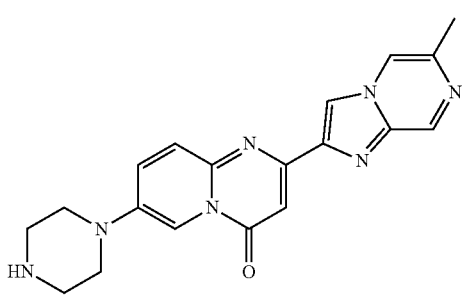
75
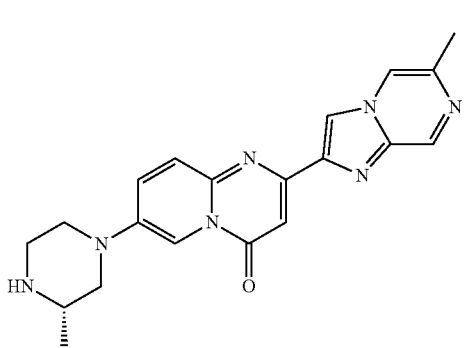
76
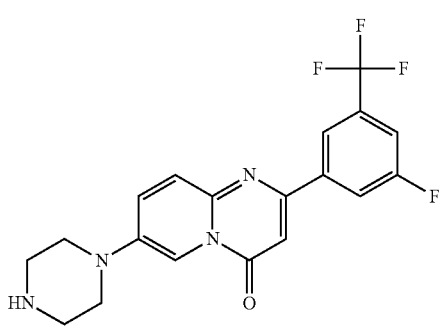

77
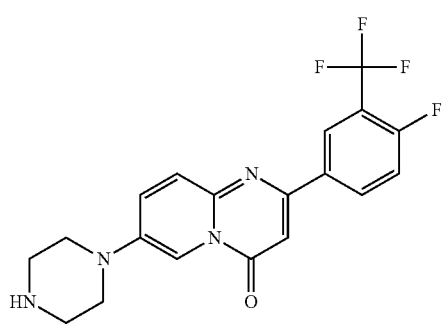
78
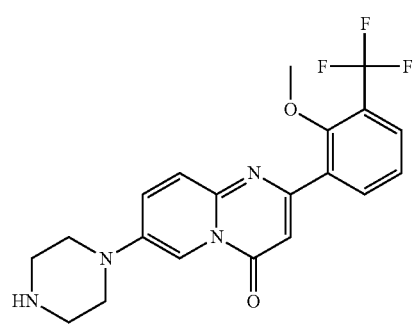
79
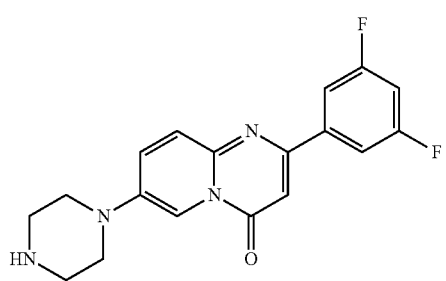
80
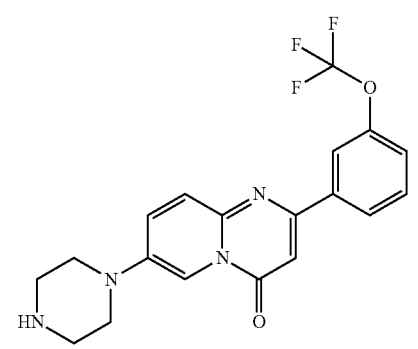
81
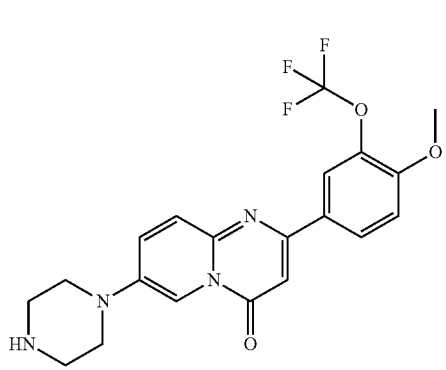
82
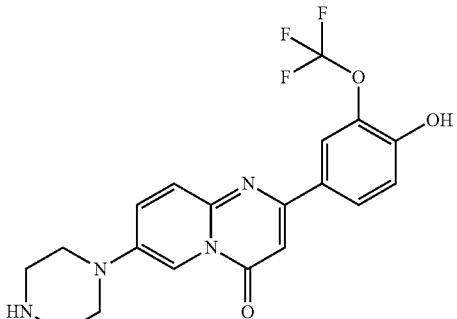
83
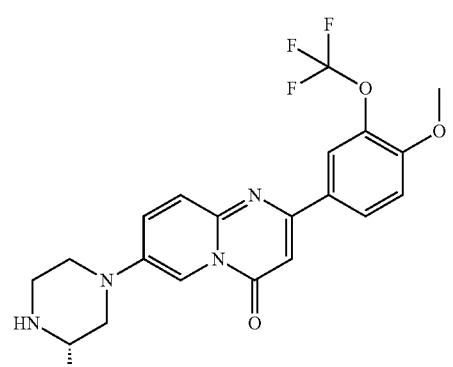
84
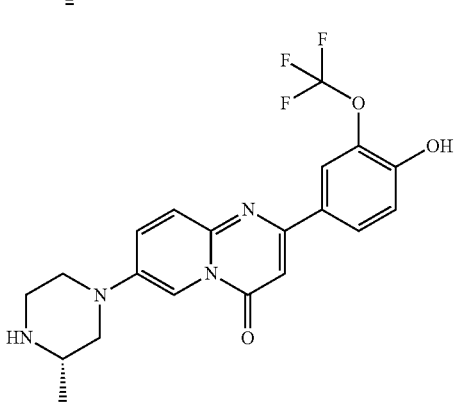
85
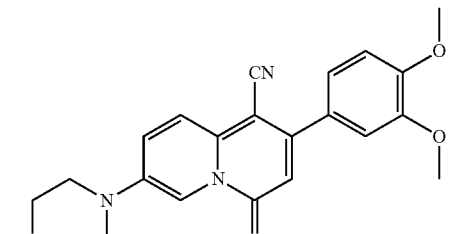
86
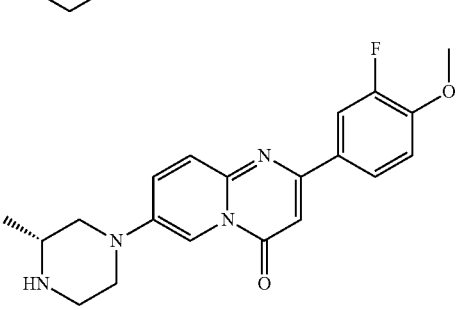

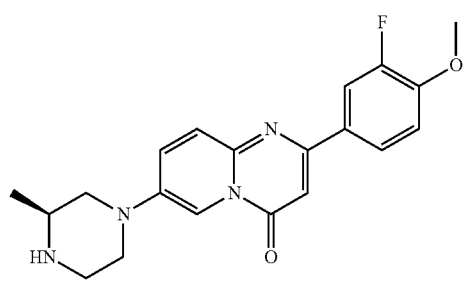
87
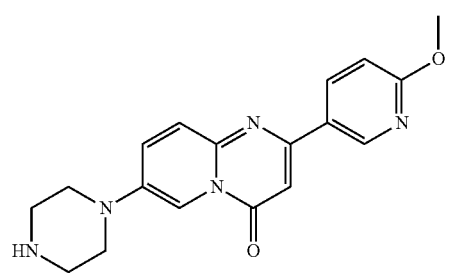
88
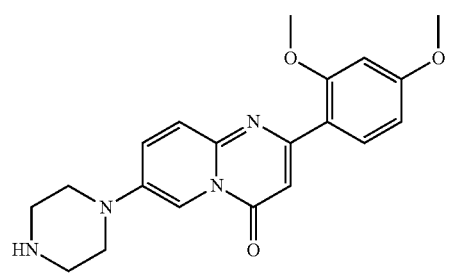
89
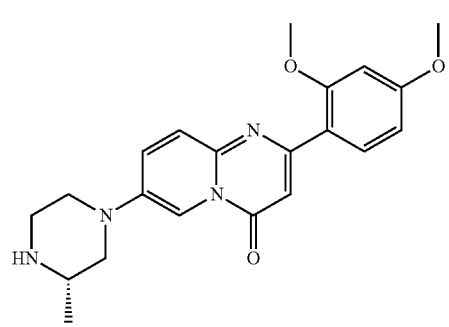
90
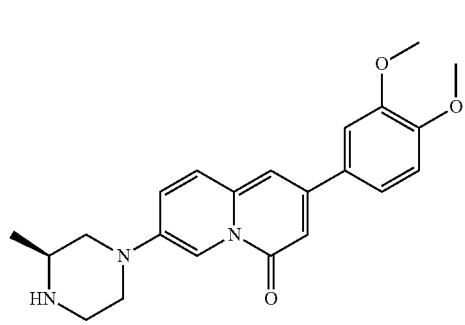
91
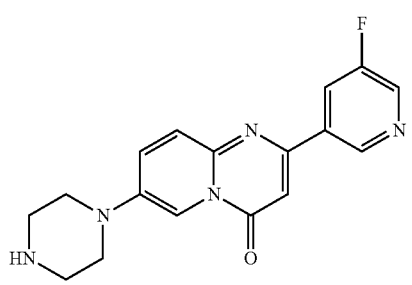
92
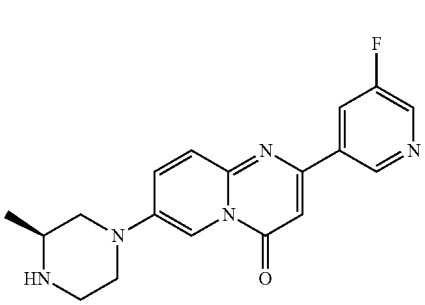
93
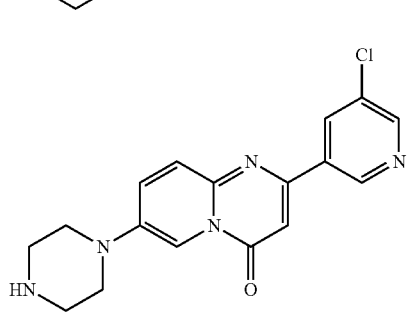
94
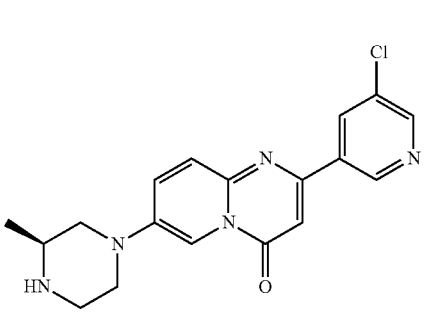
95
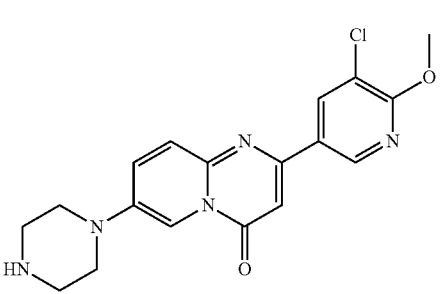
96

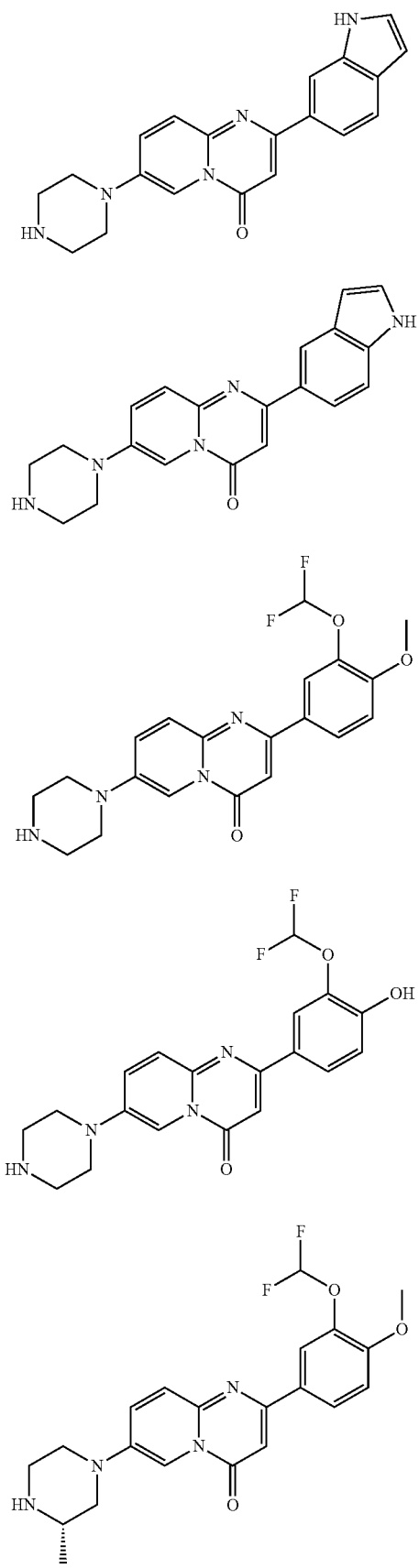

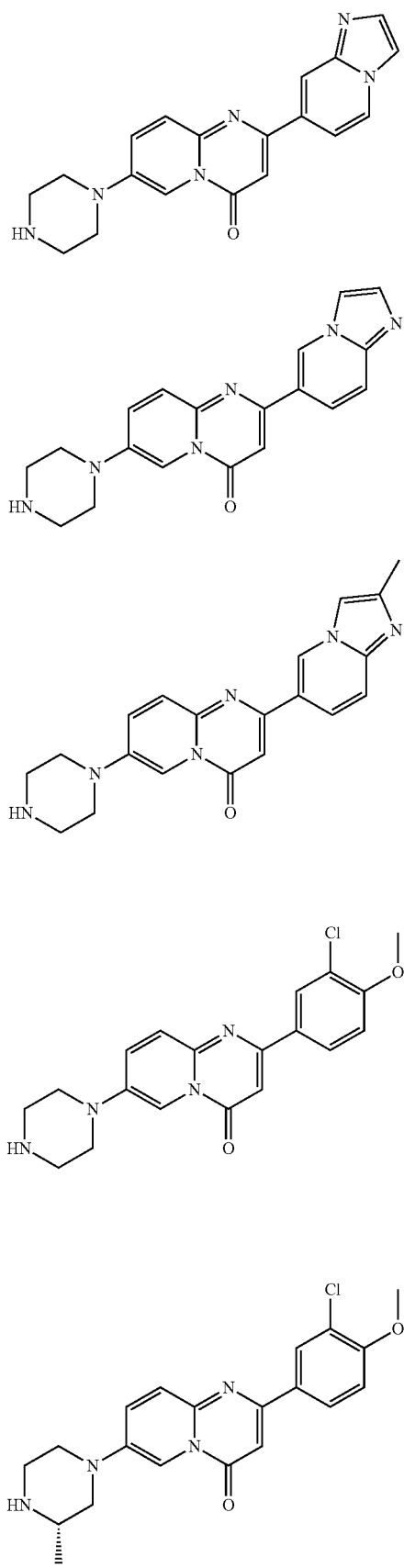

117 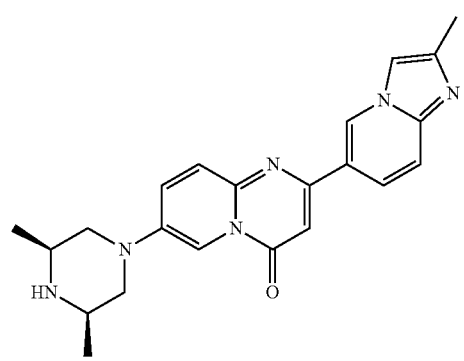
118 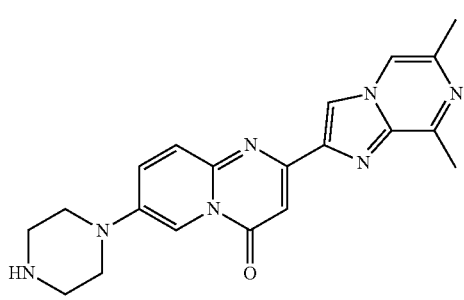
119 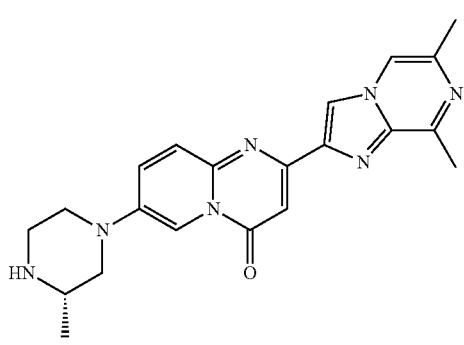
120 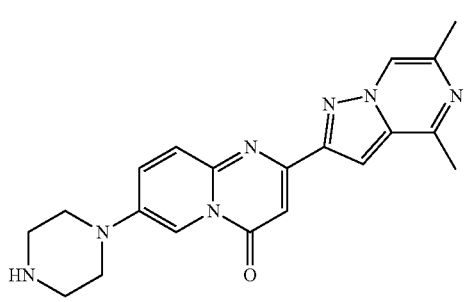
121 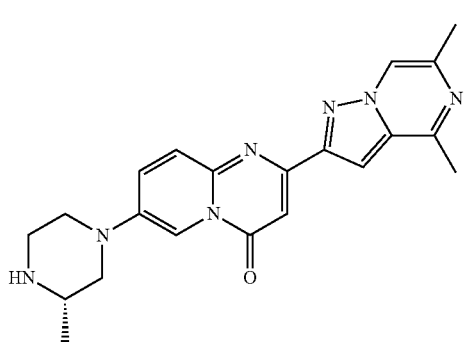
122 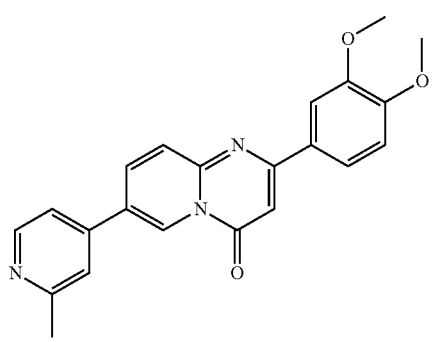
123 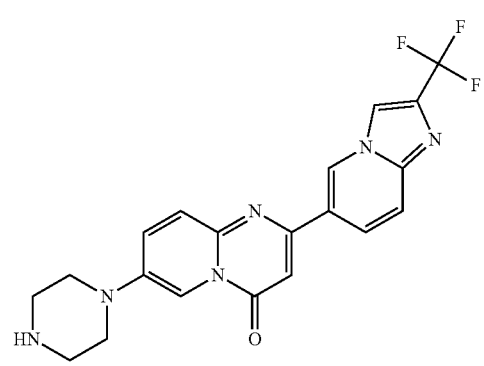
124 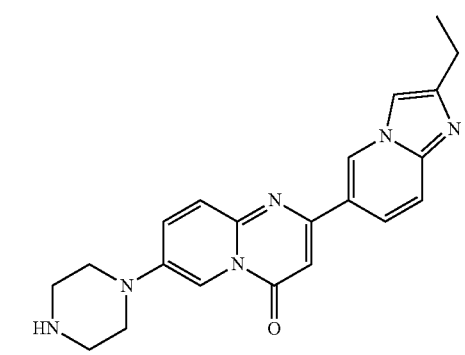
125 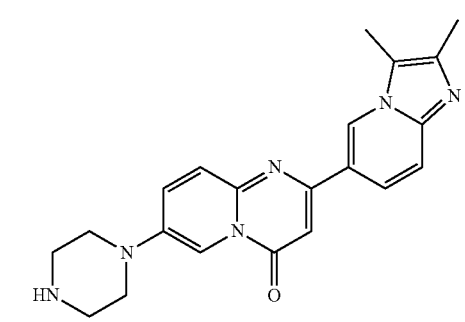

126 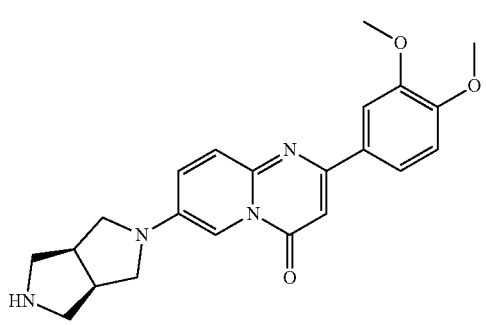
131 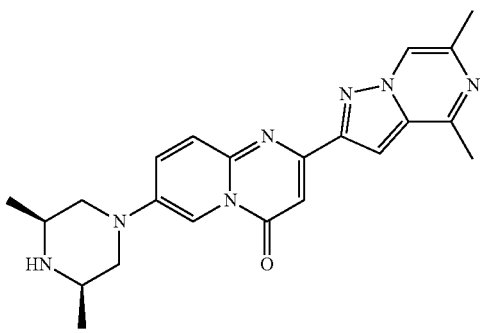
127 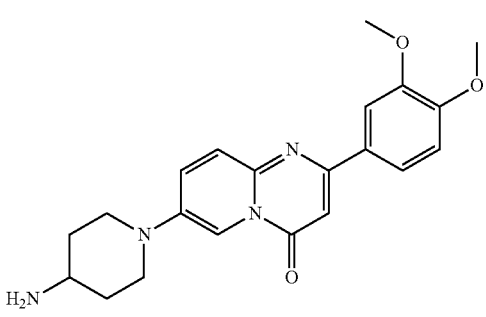
132 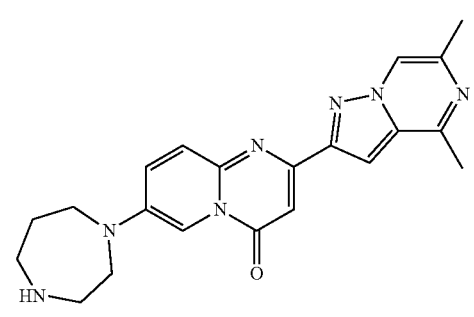
128 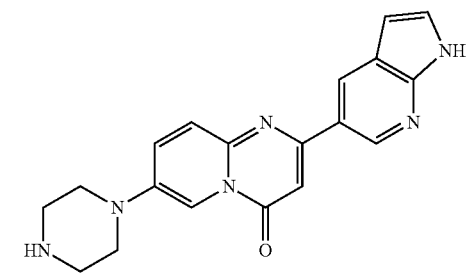
133 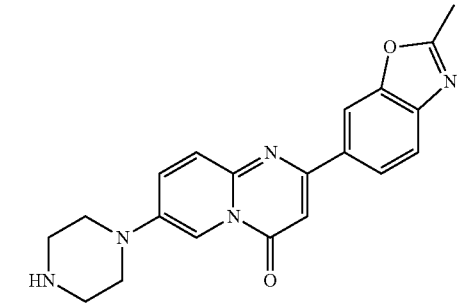
129 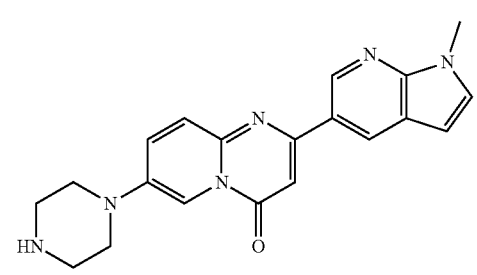
134 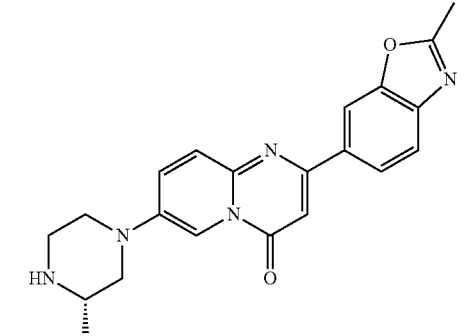
130 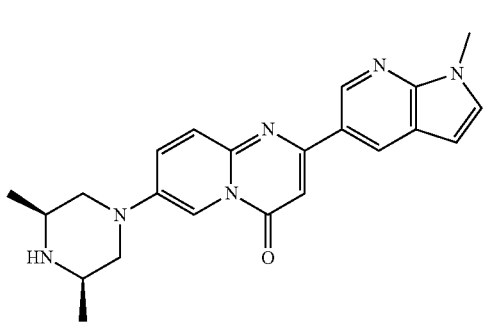
135 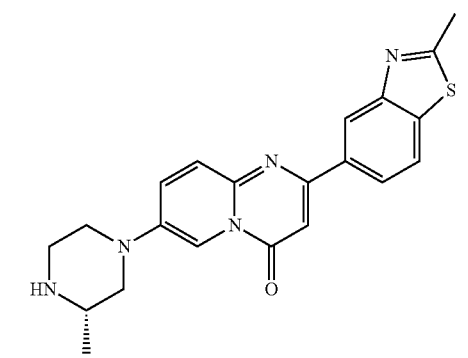

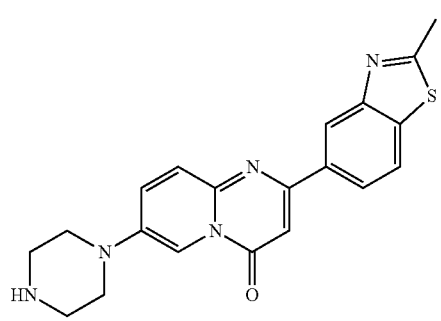
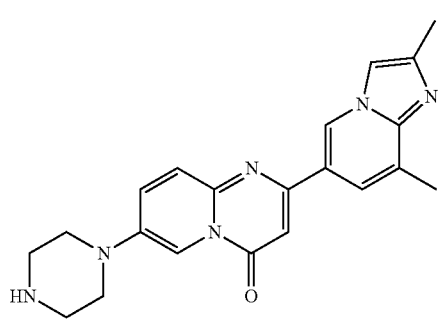
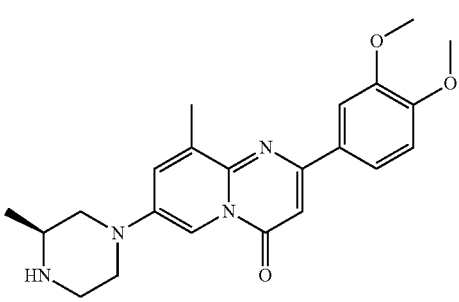
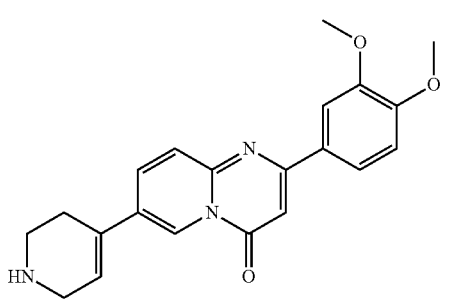
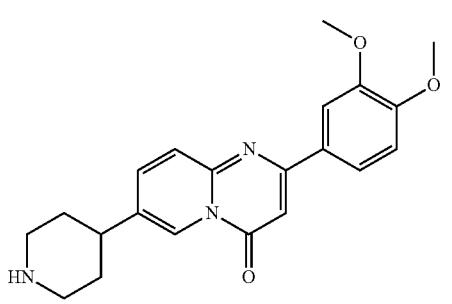
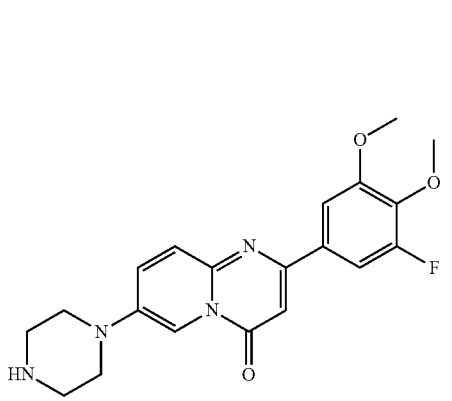

-continued
146
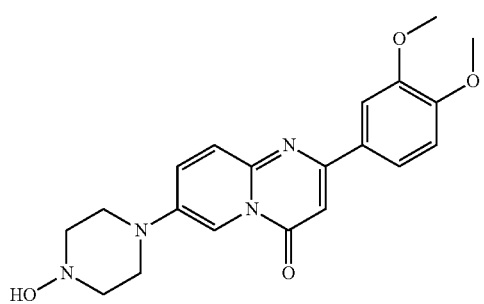
147
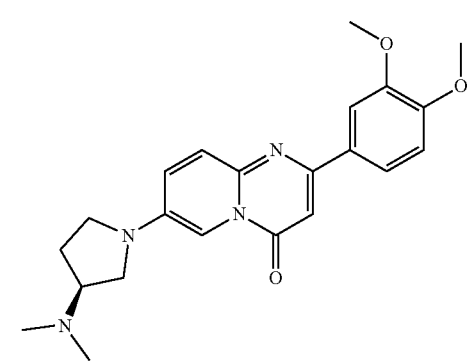
148
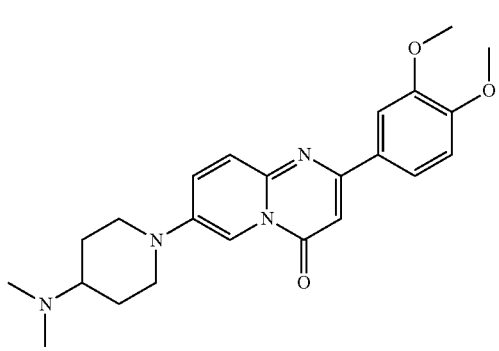
149
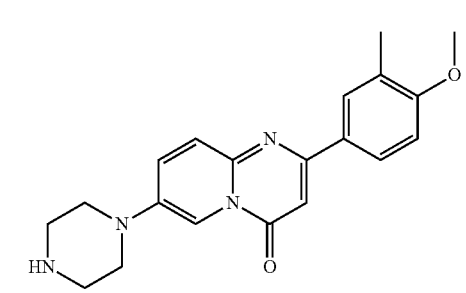
150
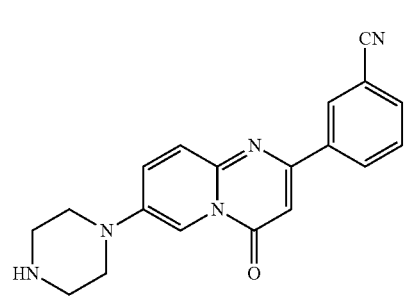
-continued
151
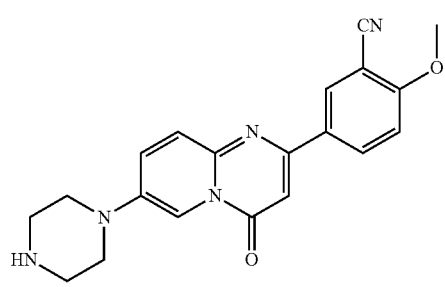
152
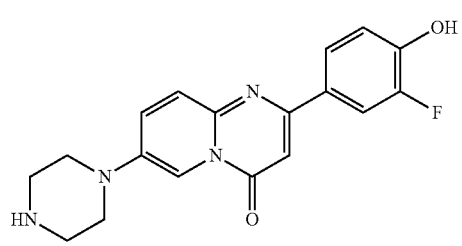
153
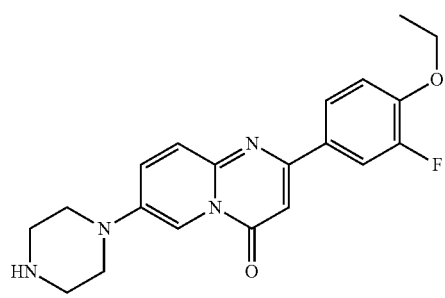
154
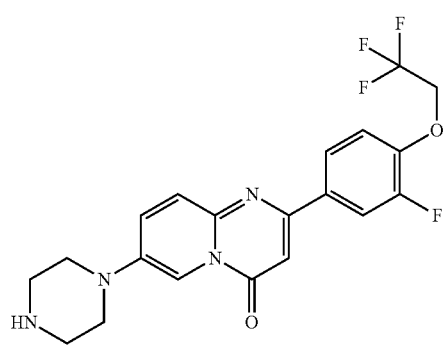
155
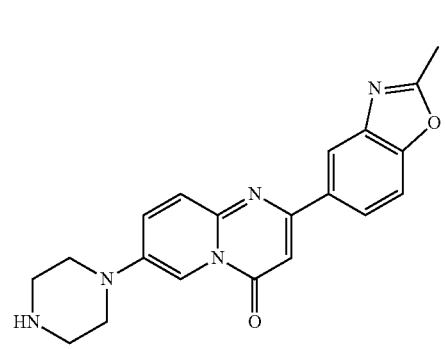

-continued
156 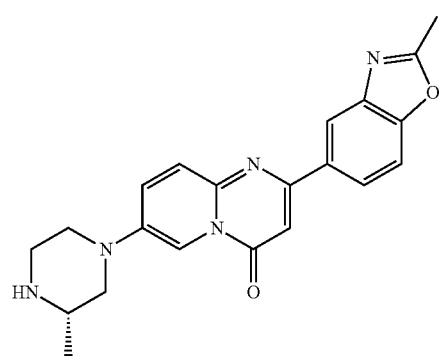
157 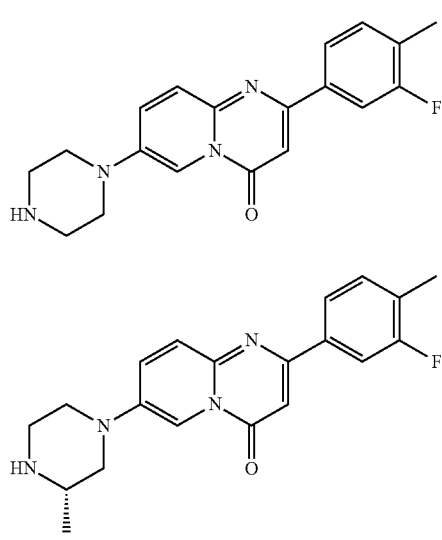
158
159 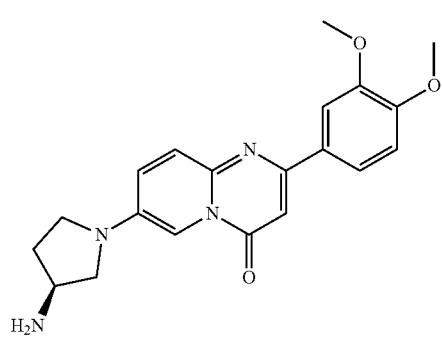
160 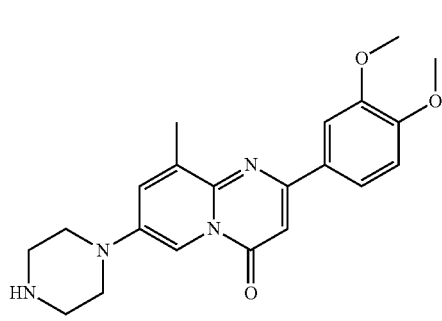
-continued
161 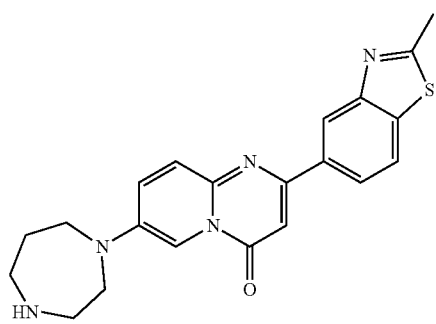
162 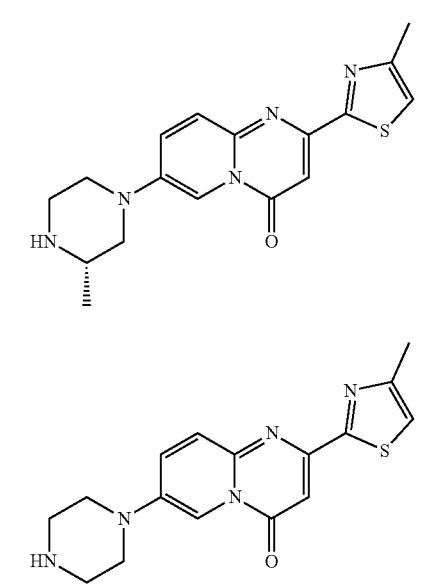
163
164 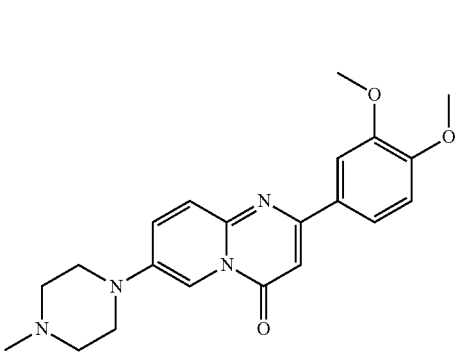
165 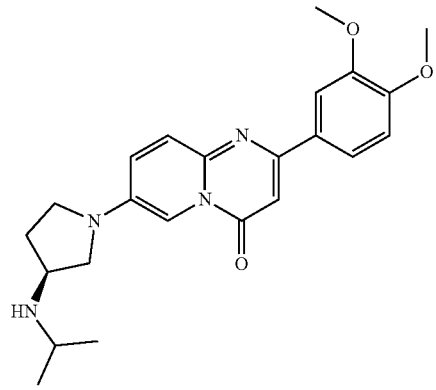

| | |
|---|---|
| 166 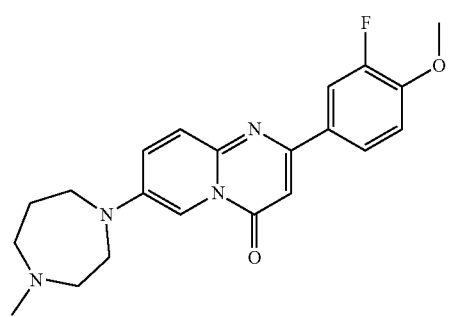 | 171 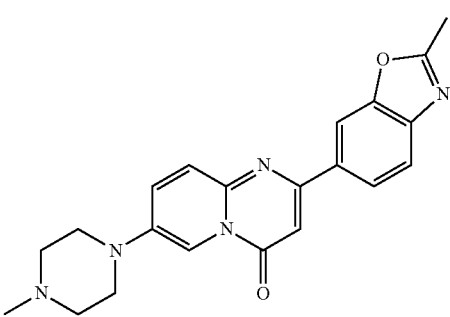 |
| 167 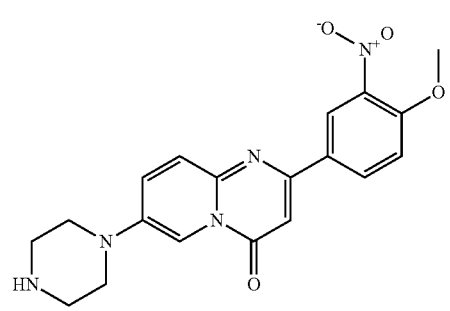 | 172 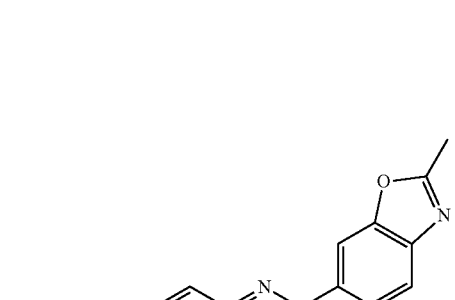 |
| 168 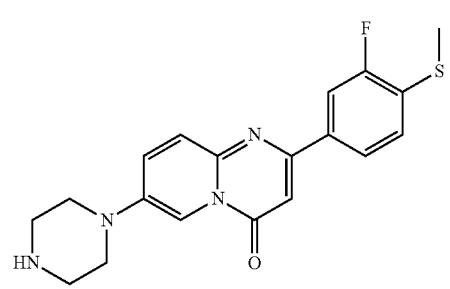 | 173 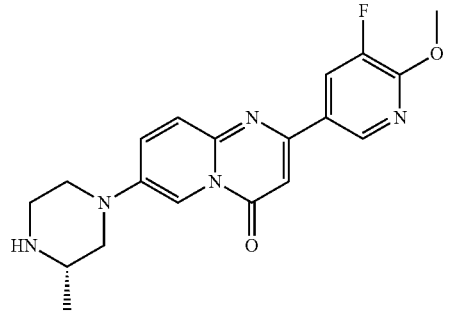 |
| 169 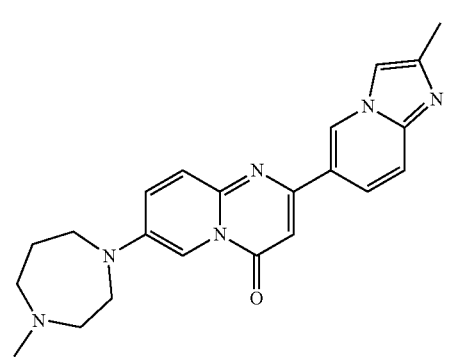 | 174 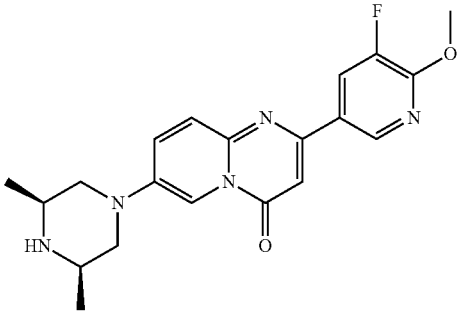 |
| 170 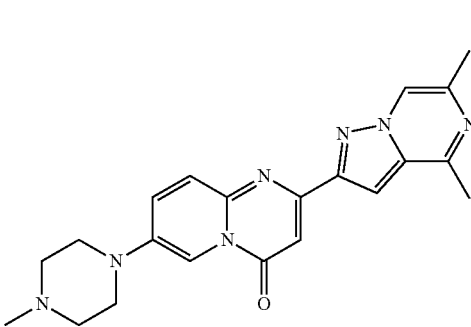 | |

175
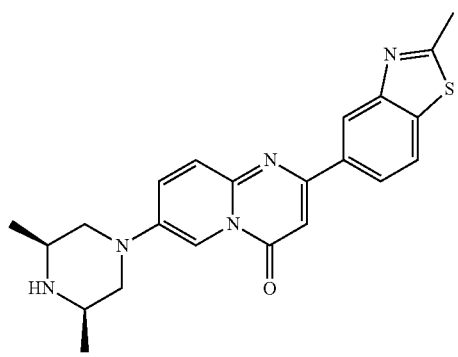
176
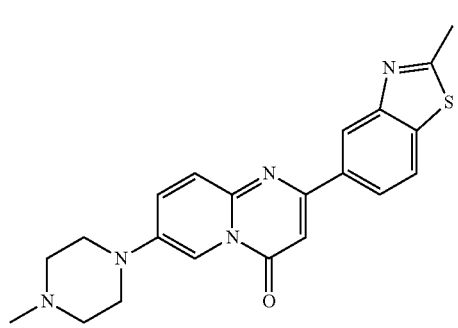
177
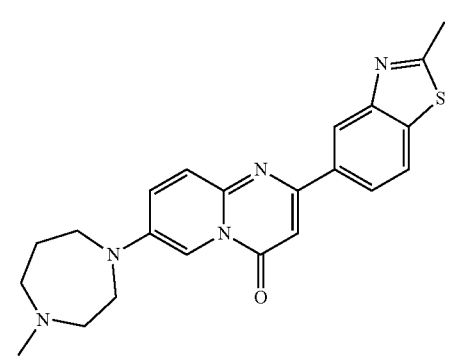
178
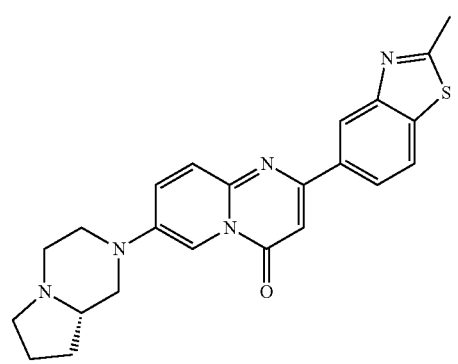
179
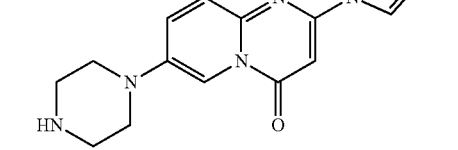
180
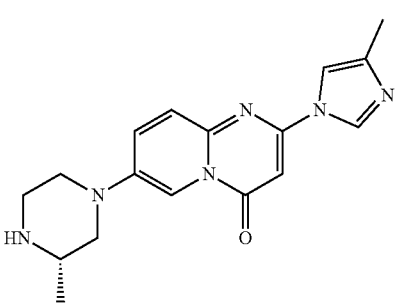
181
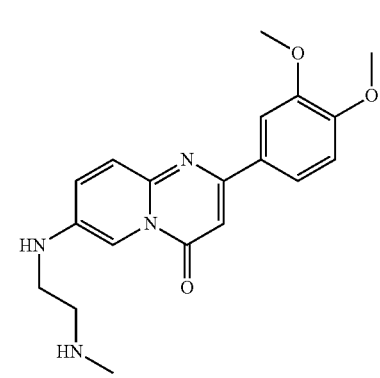
182
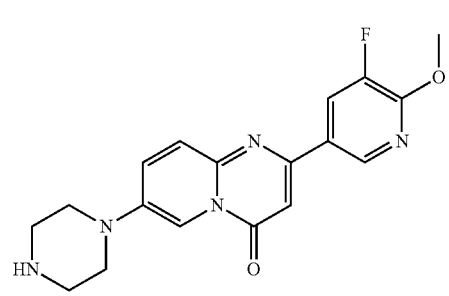
183
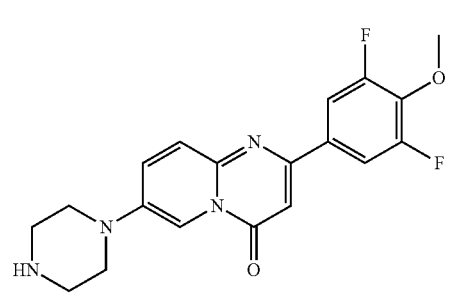
184
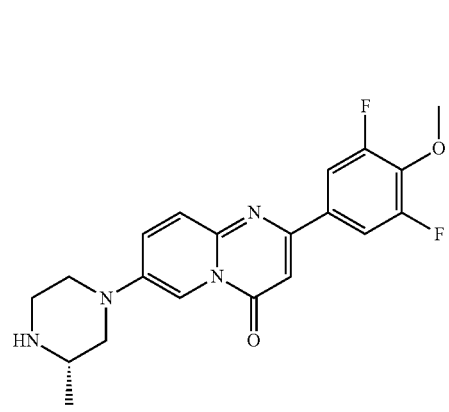

185 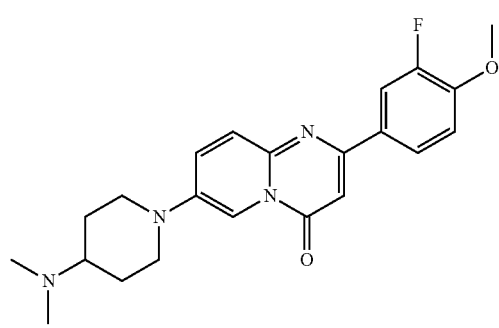
186 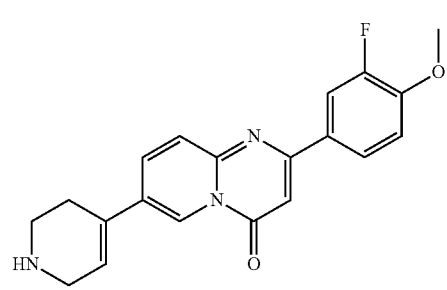
187 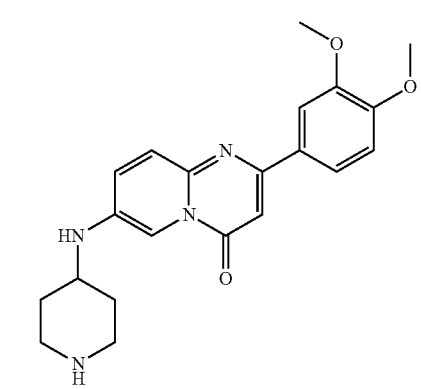
188 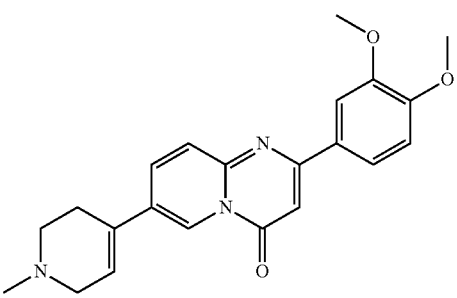
189 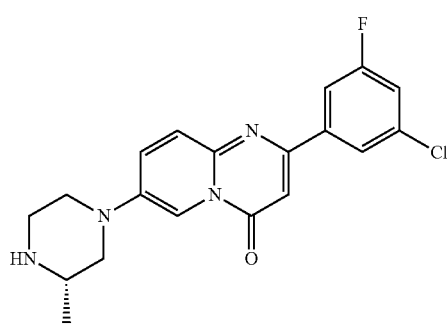
190 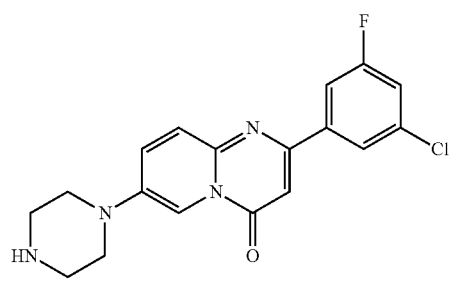
191 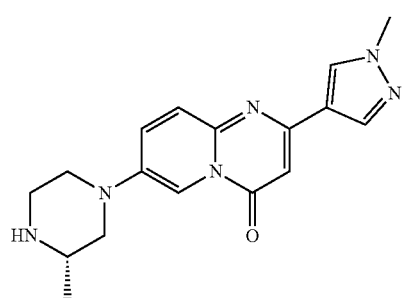
192 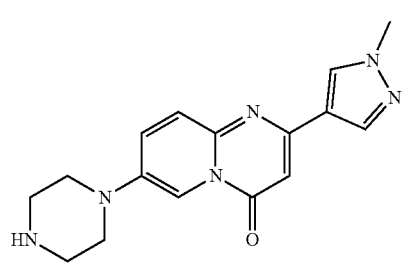
193 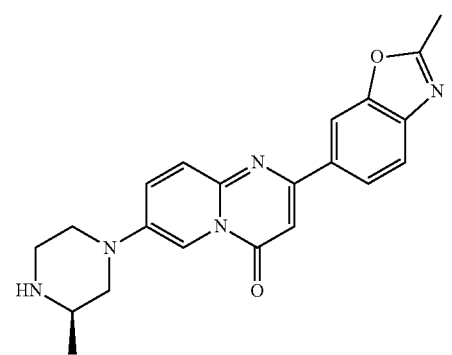
194 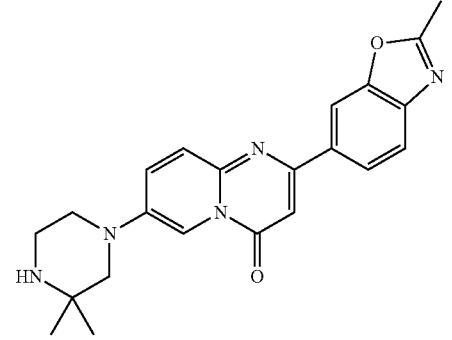

-continued
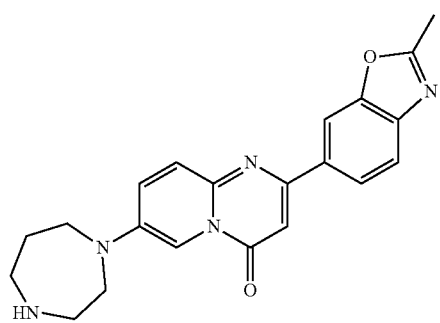
195
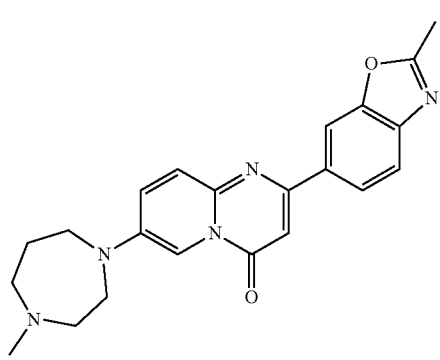
196
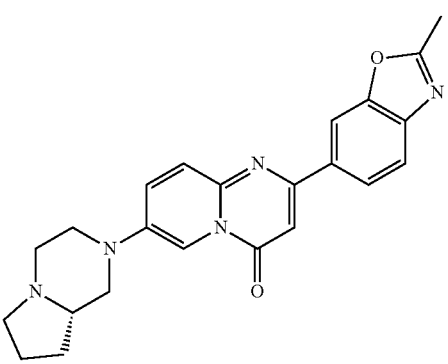
197
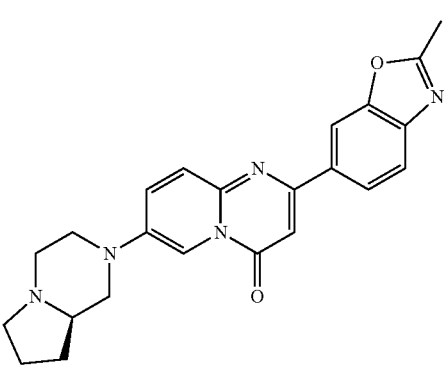
198
-continued
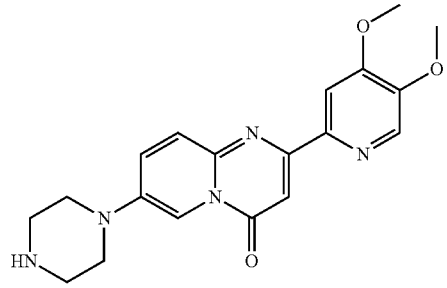
199
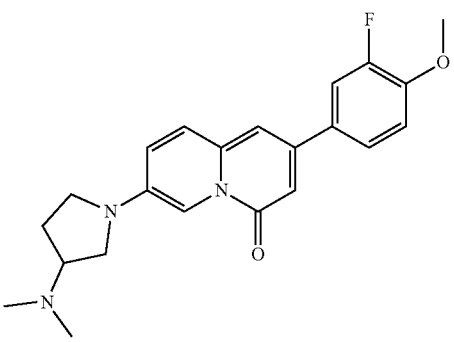
200
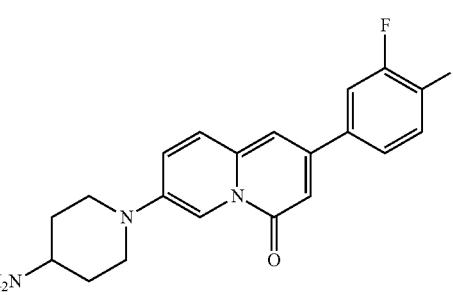
201
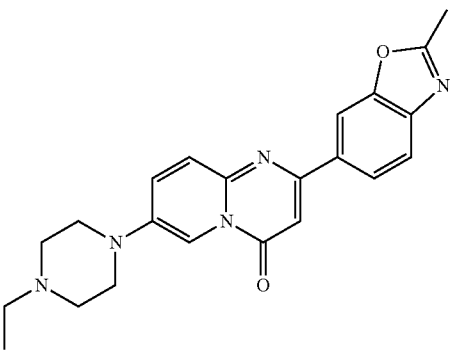
202
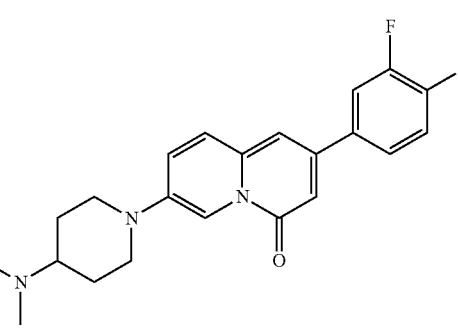
203

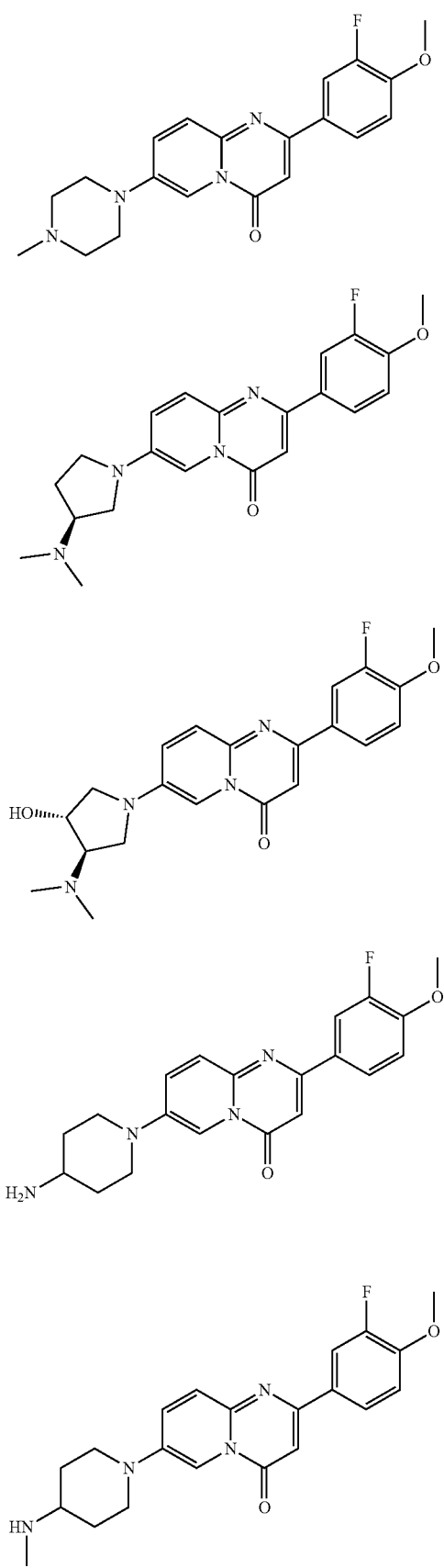
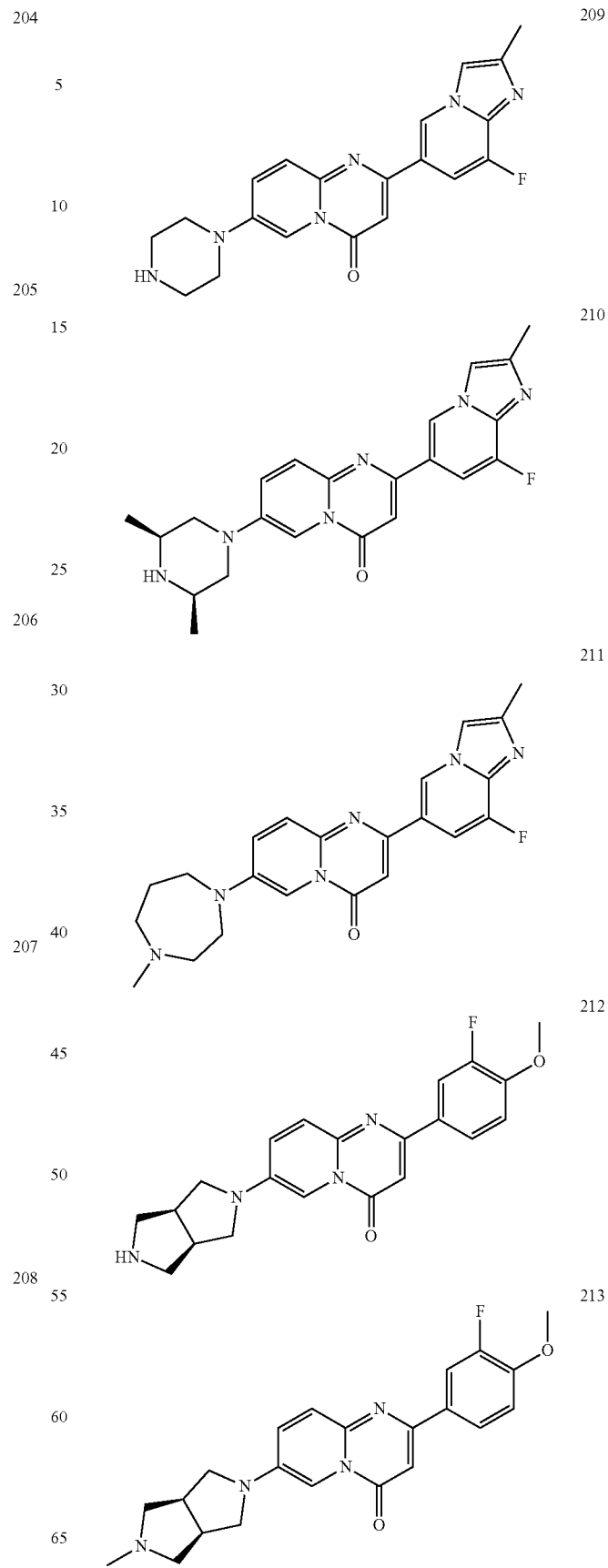

| | |
|---|---|
| 214 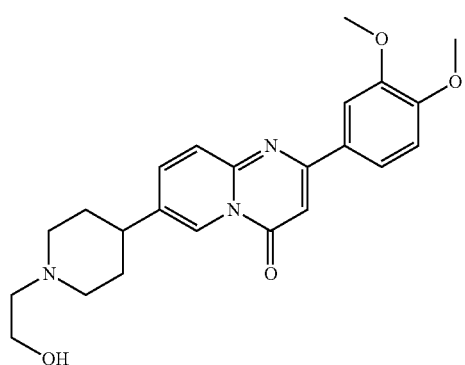 | 219 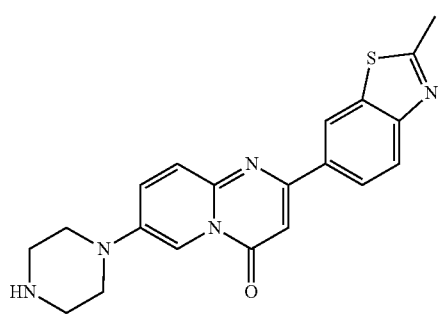 |
| 215 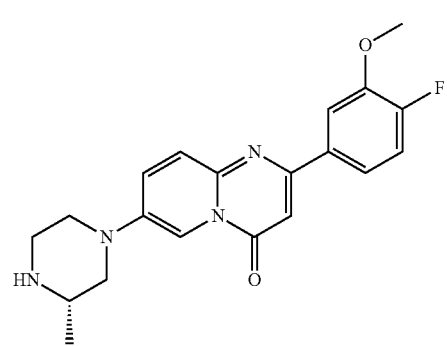 | 220 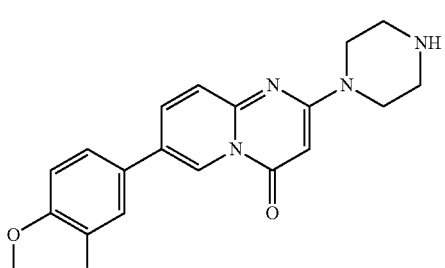 |
| 216 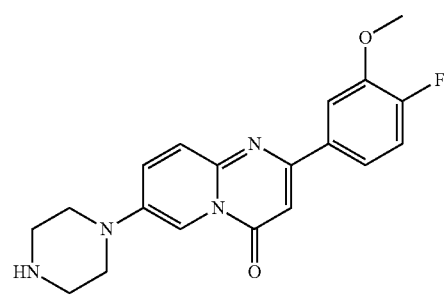 | 221 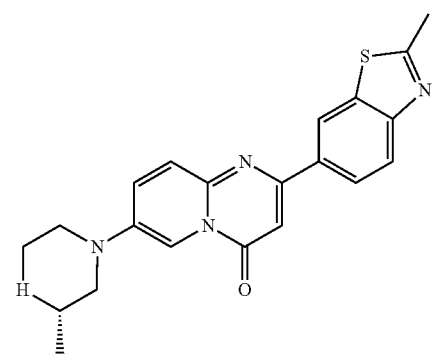 |
| 217 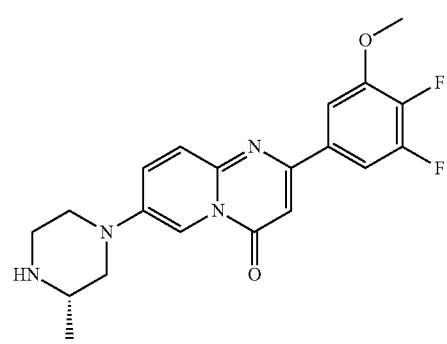 | 222 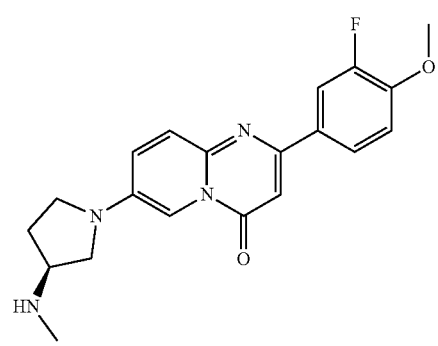 |
| 218 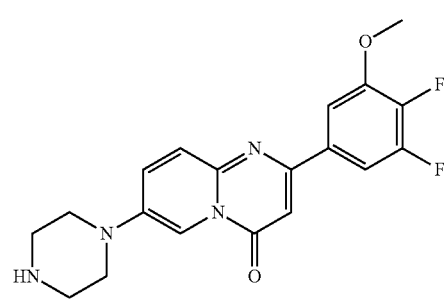 | 223 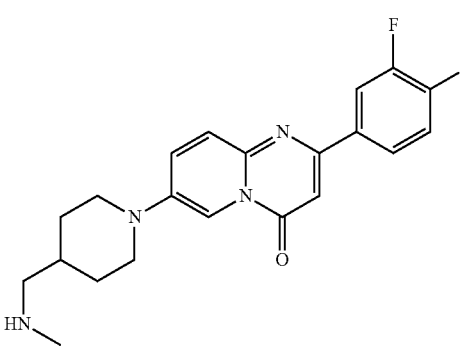 |

| 224 | 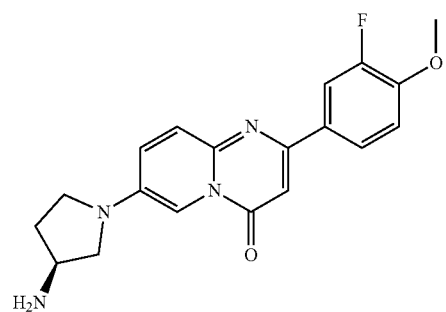 |
| 225 | 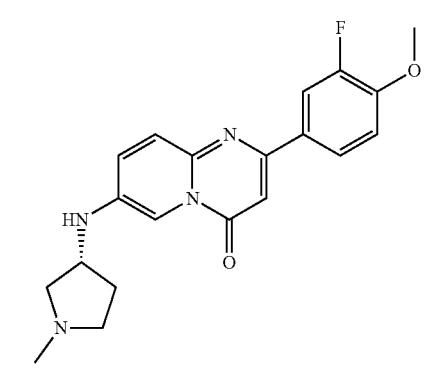 |
| 226 | 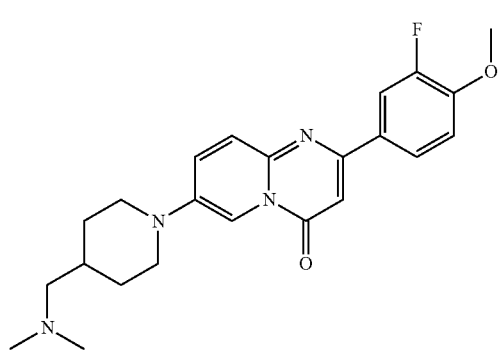 |
| 227 | 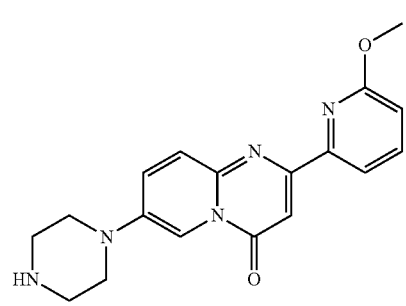 |
| 228 | 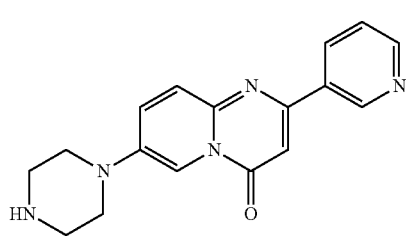 |
| 229 | 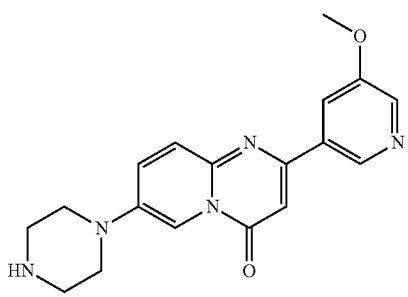 |
| 230 | 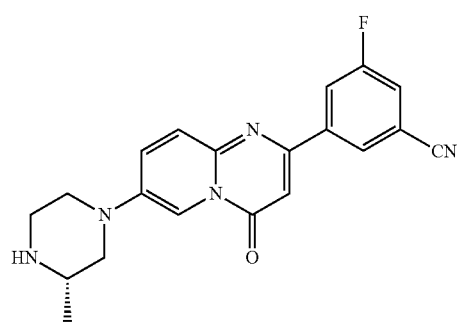 |
| 231 | 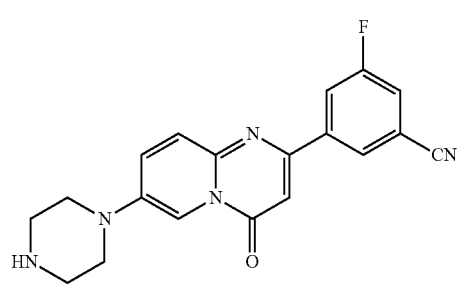 |
| 232 | 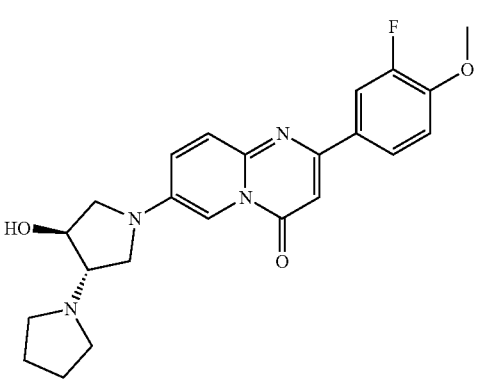 |
| 233 | 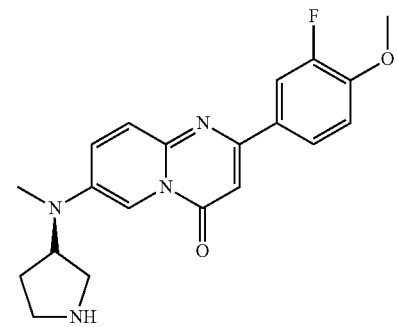 |

234 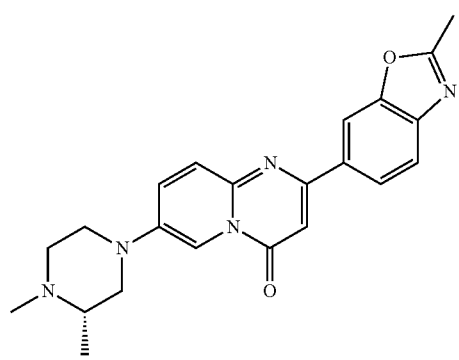
235 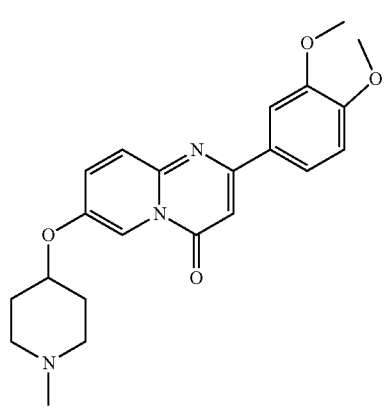
236 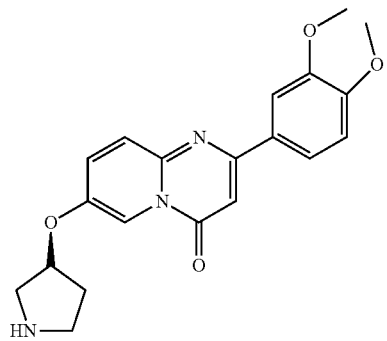
237 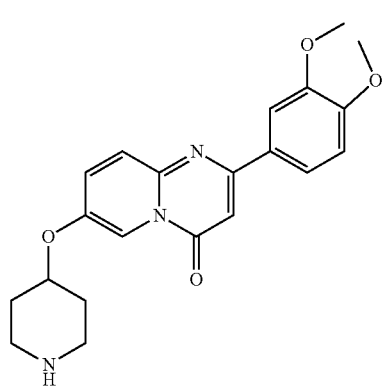
238 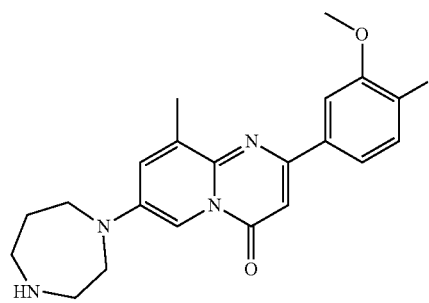
239 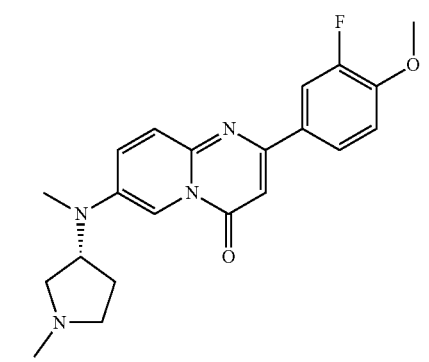
240 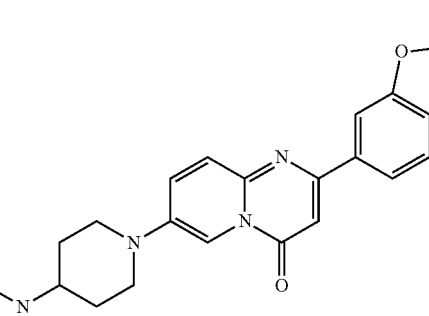
241 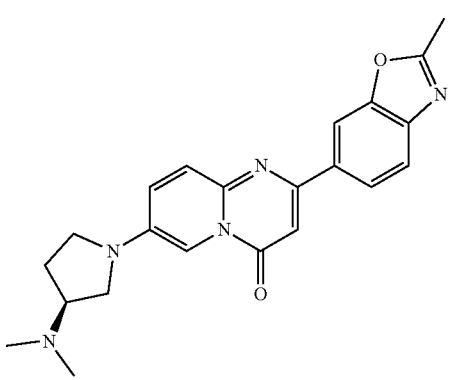

242
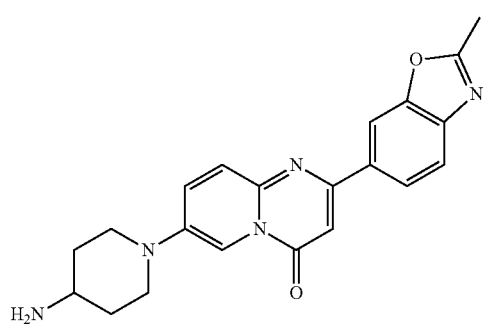
243
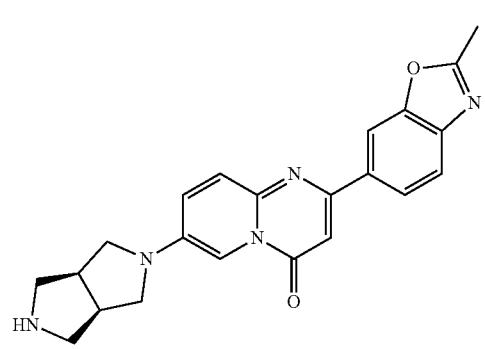
244
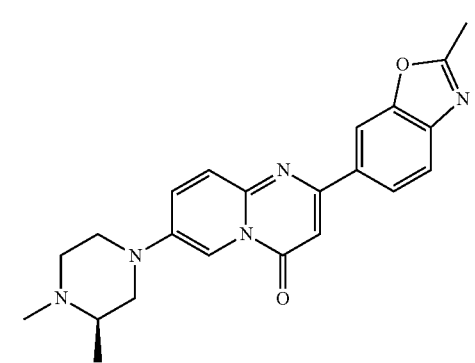
245
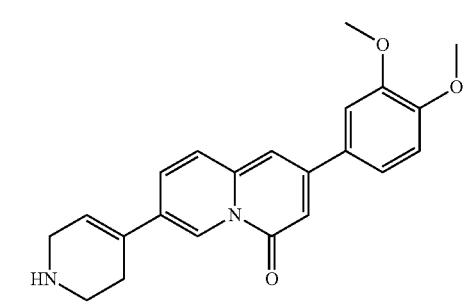
246
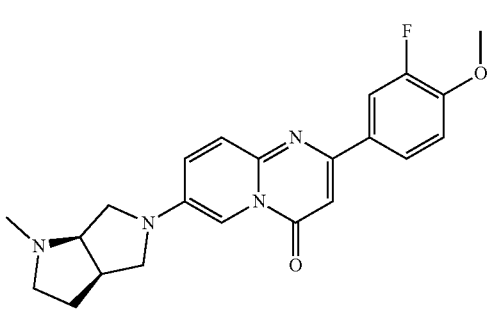
247
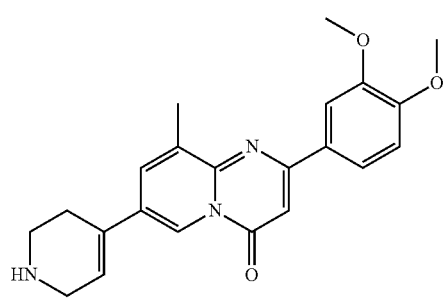
248
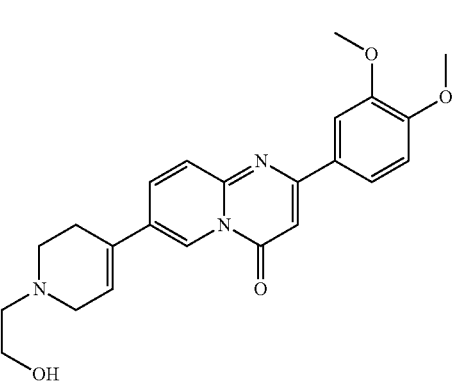
249
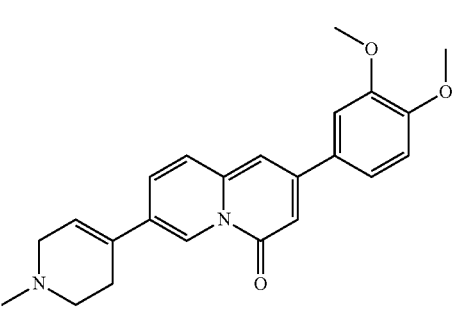
250
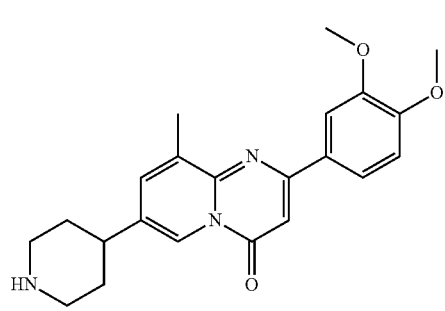
251
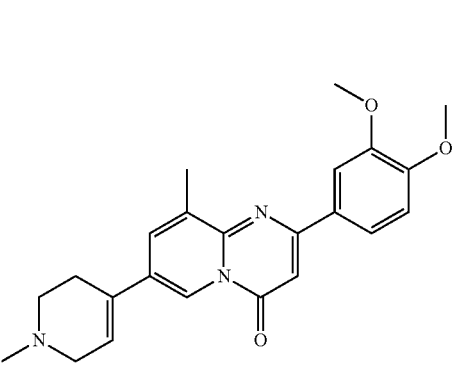

252
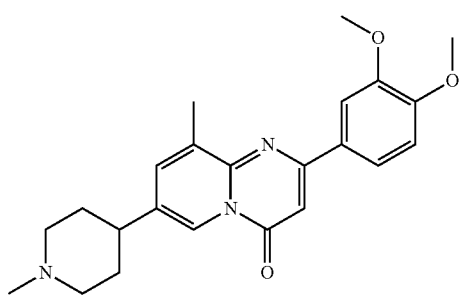
253
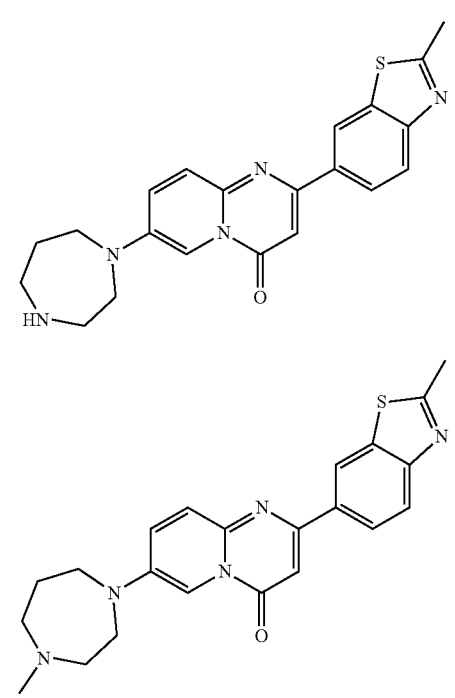
254
255
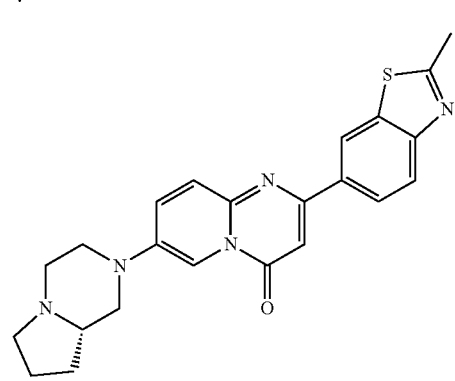
256
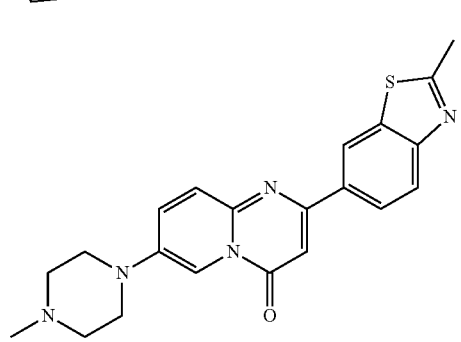
257
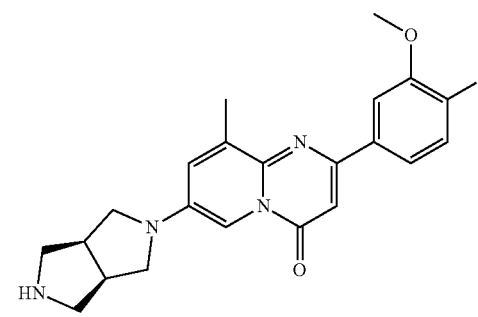
258
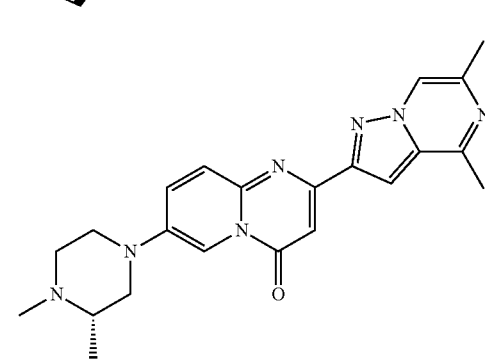
259
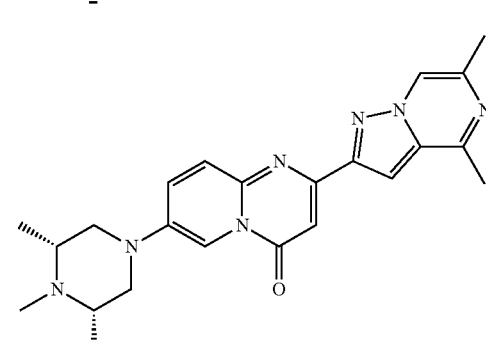
260
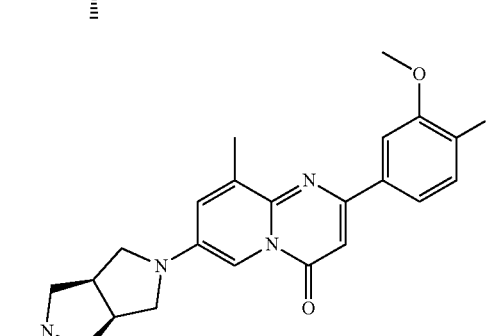
261
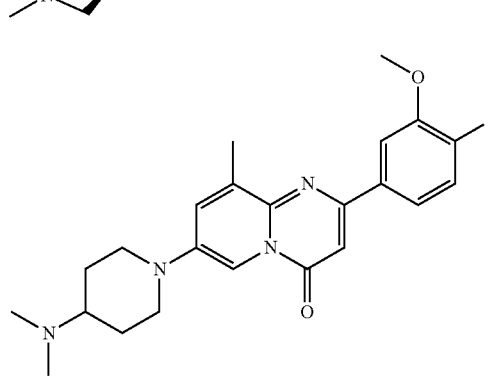

262
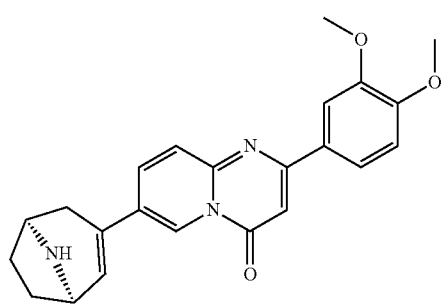
263
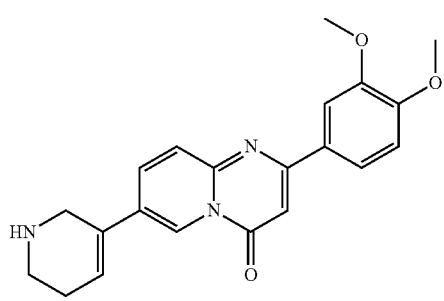
264
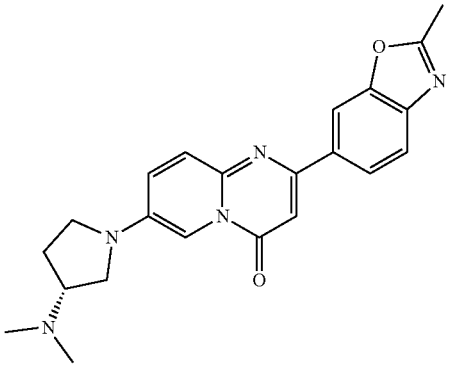
265
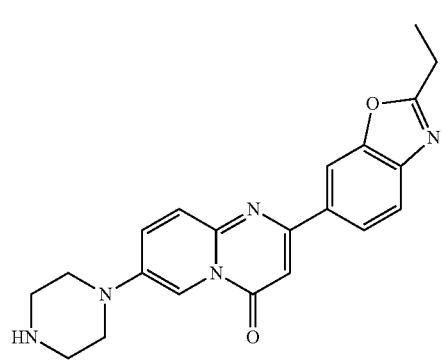
266
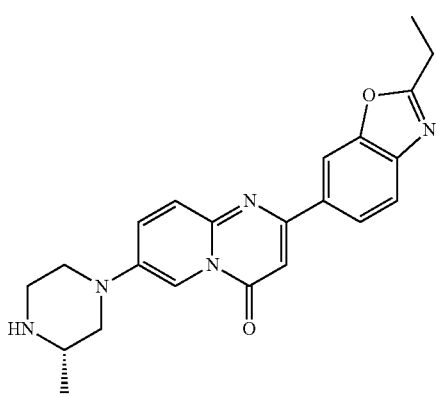
267
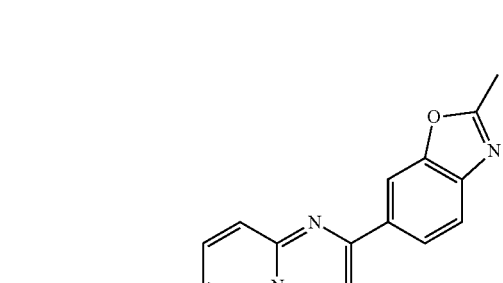
268
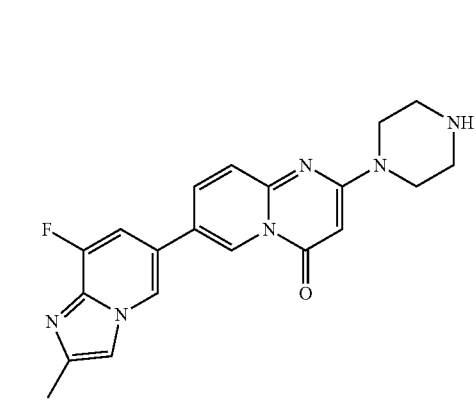
269
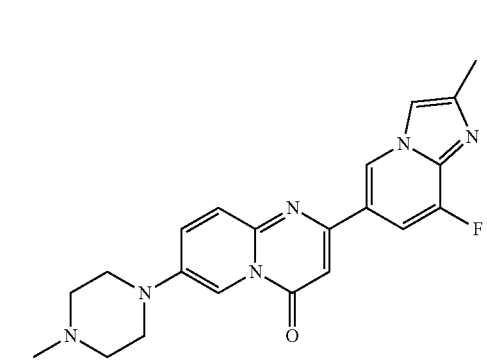

270 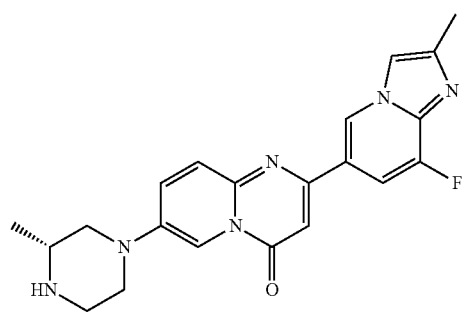
271 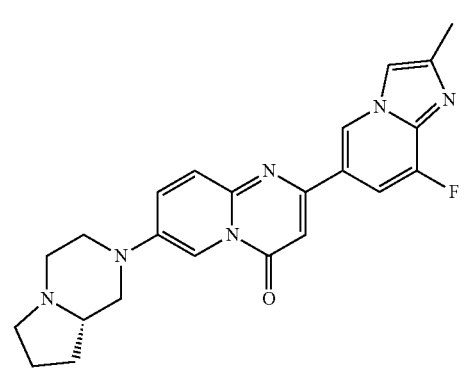
272 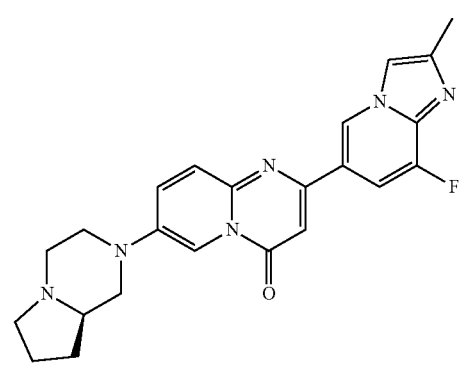
273 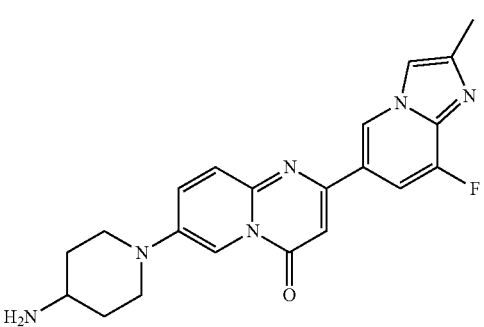
274 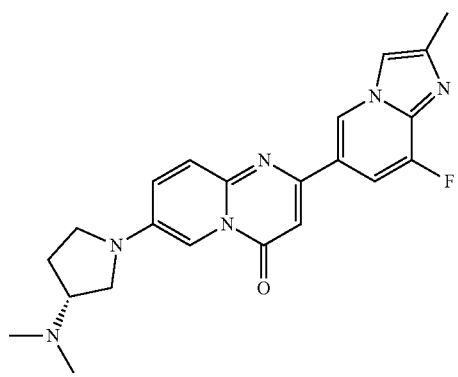
275 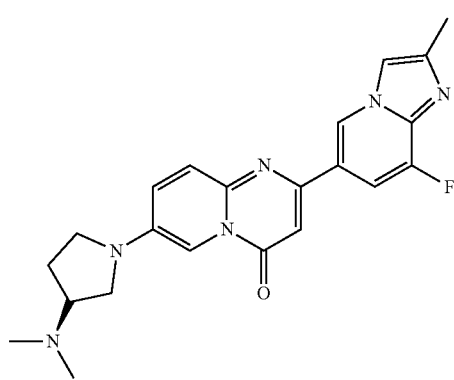
276 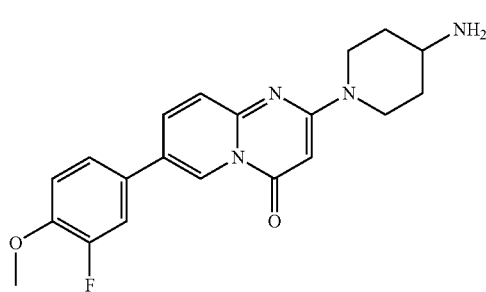
277 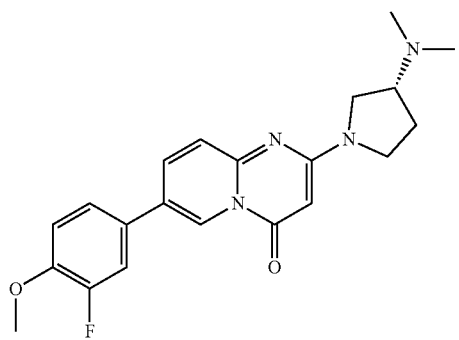

278 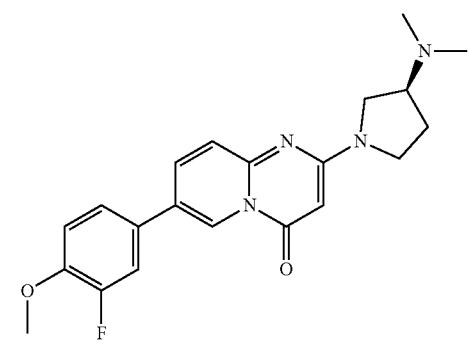
279 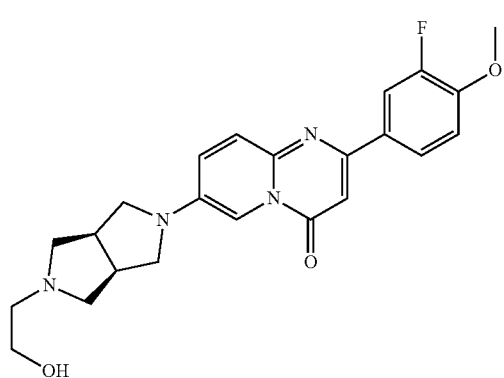
280 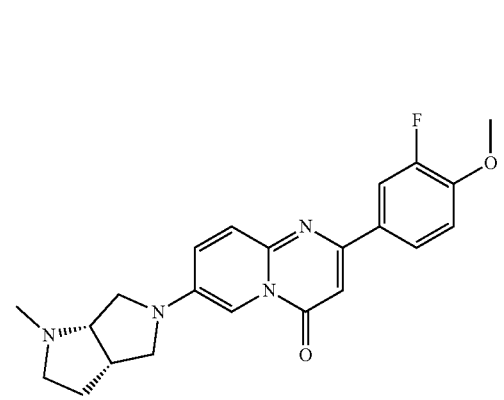
281 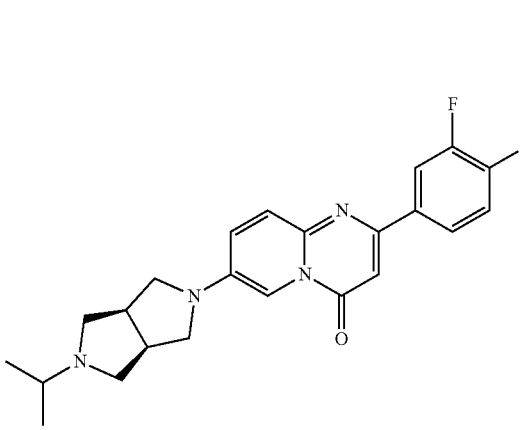
282 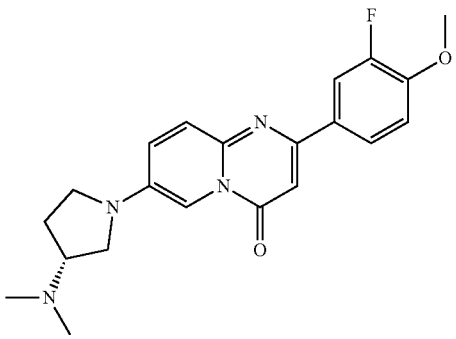
283 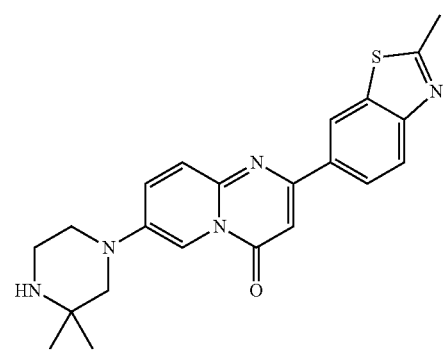
284 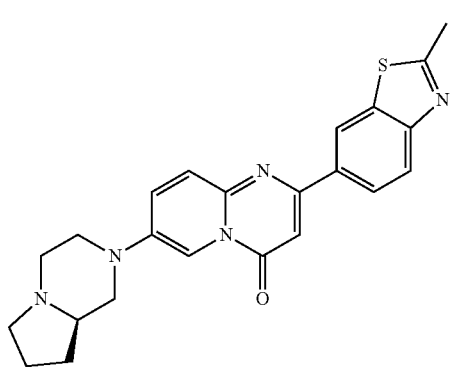
285 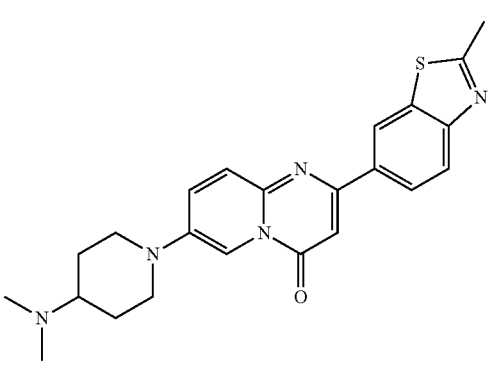

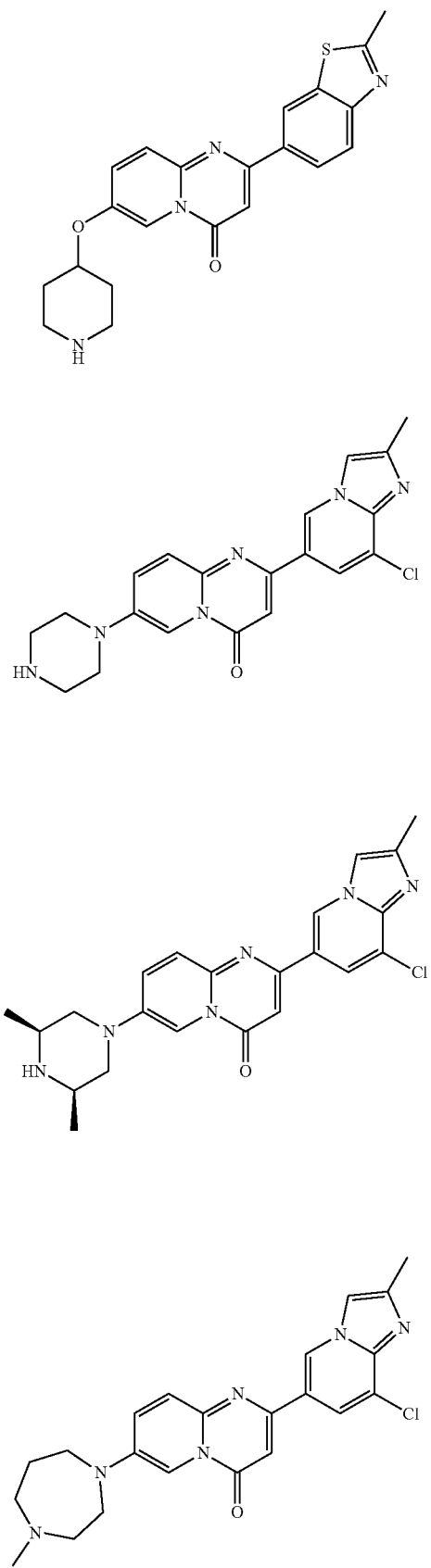

295 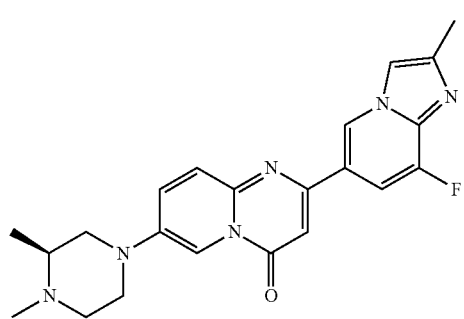
296 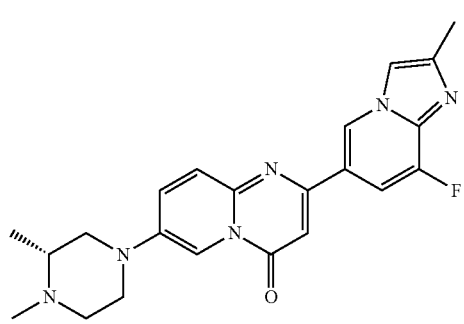
297 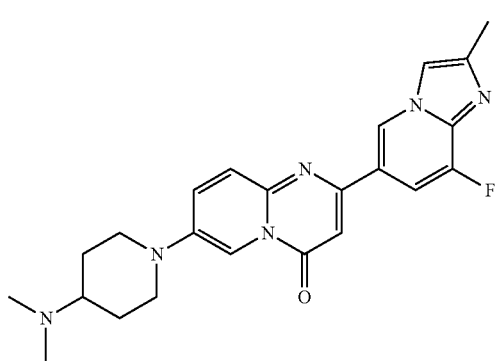
298 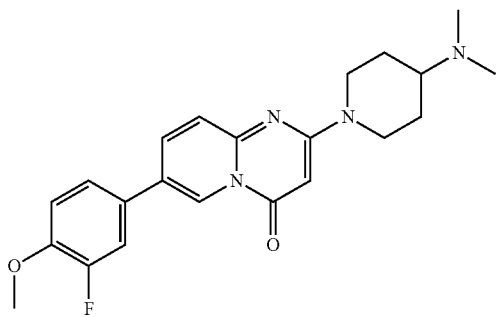
299 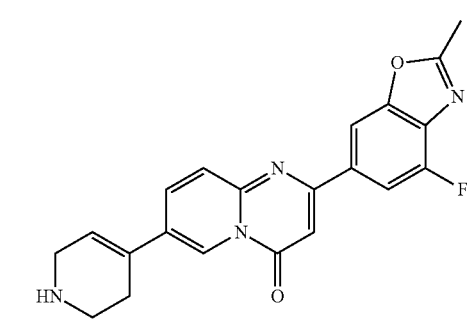
300 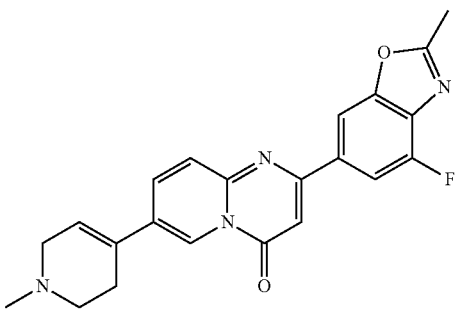
301 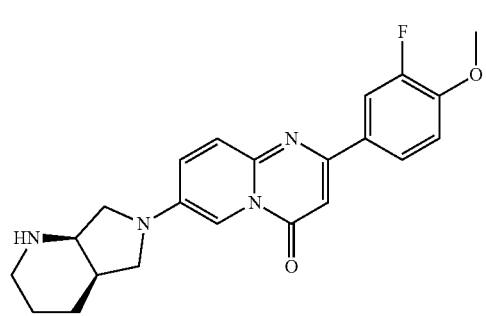
302 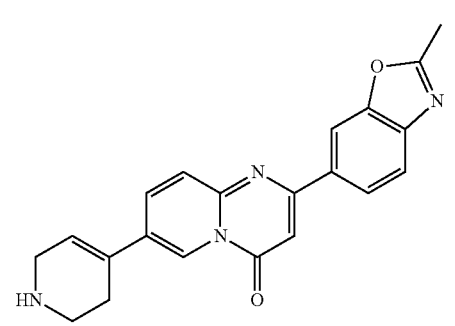
303 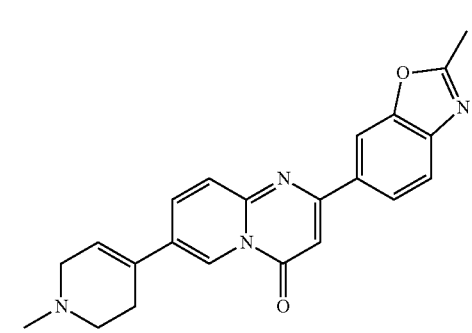
304 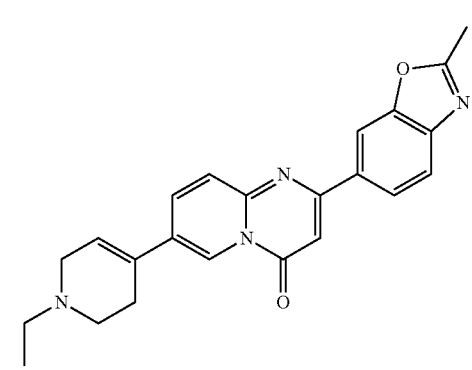

293
-continued
305
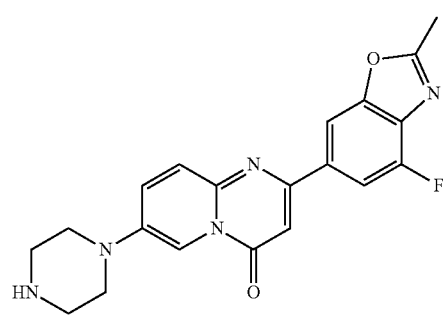
306
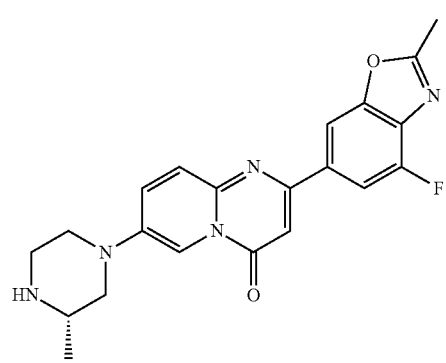
307
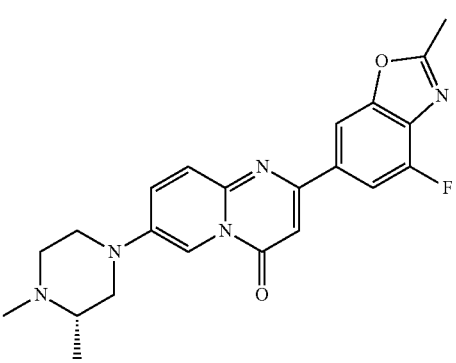
308
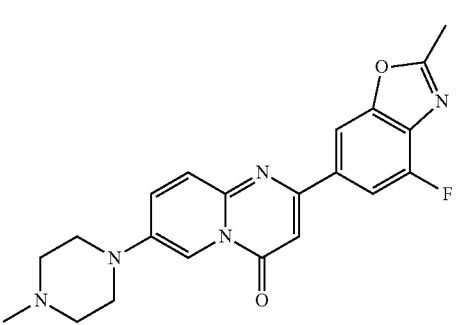
294
-continued
309
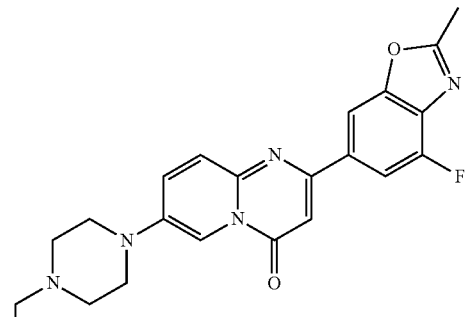
310
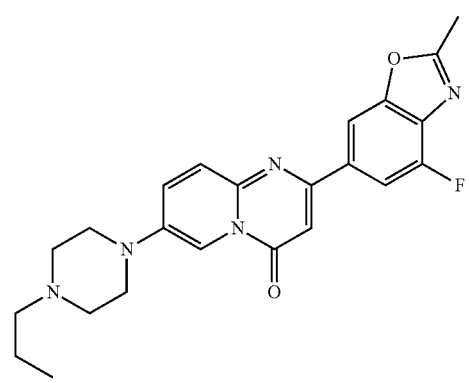
311
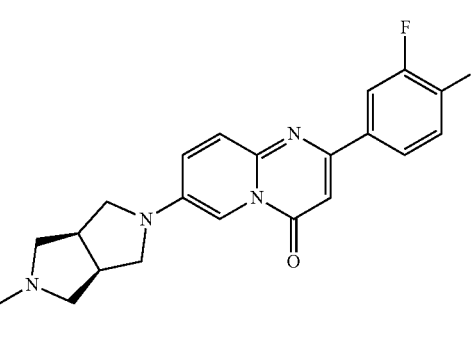
312
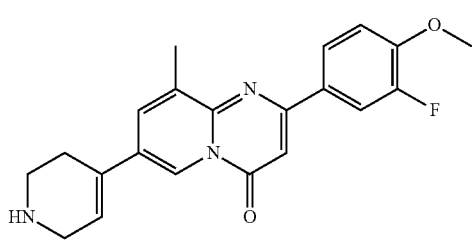
313
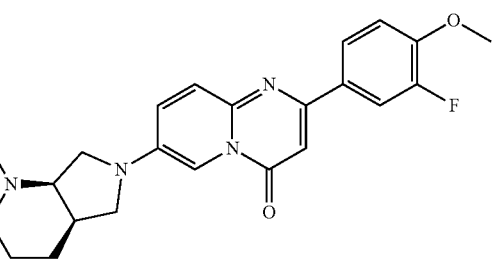

314
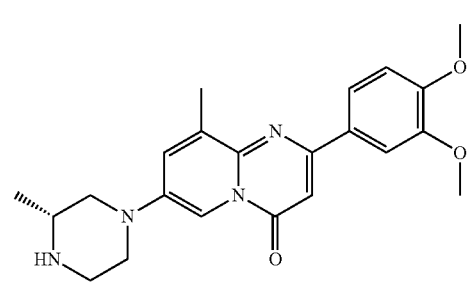
315
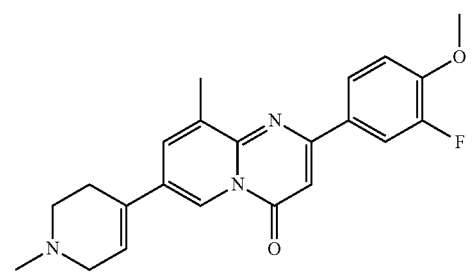
316
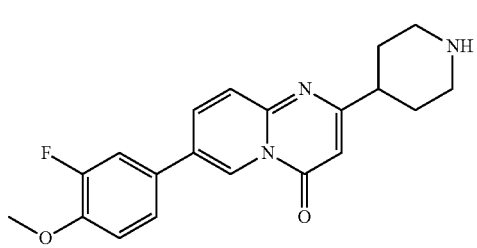
317
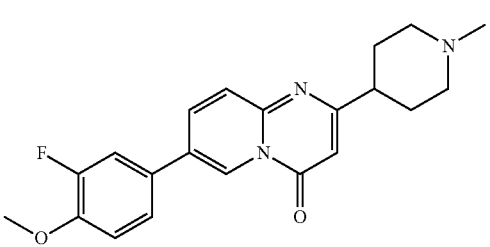
318
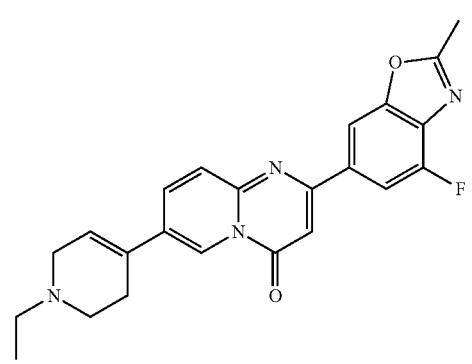
319
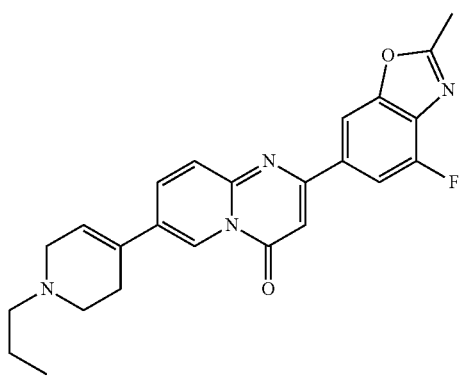
320
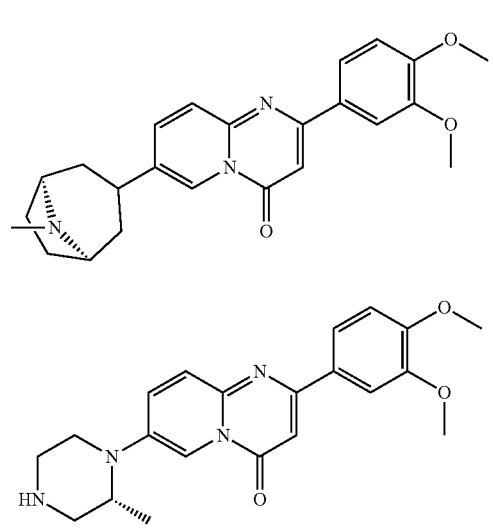
321
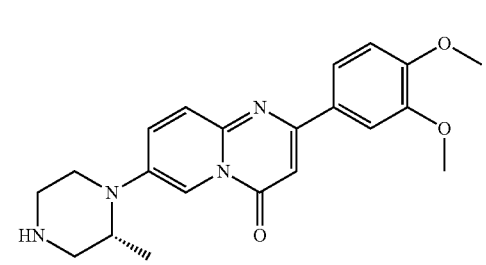
322
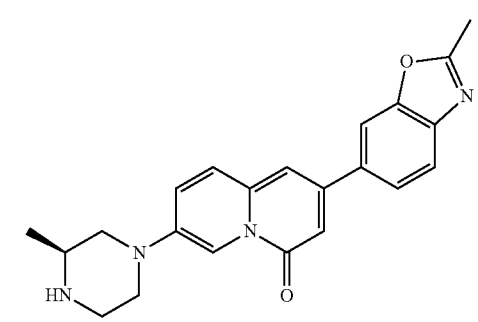
323
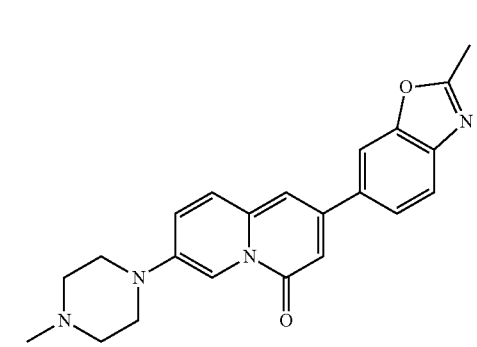

324
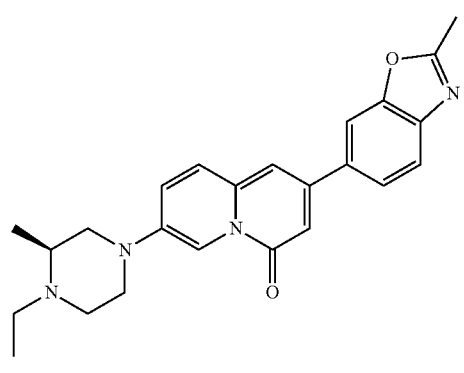
325
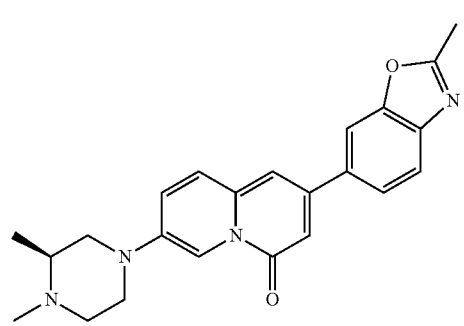
326
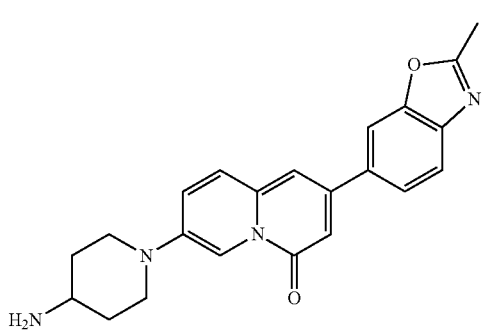
327
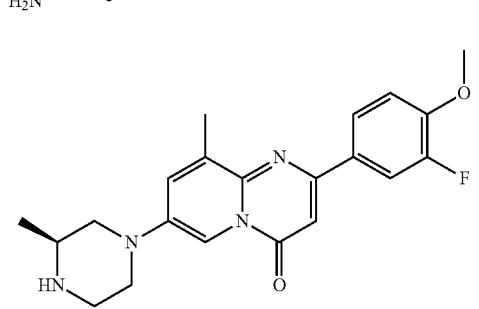
328
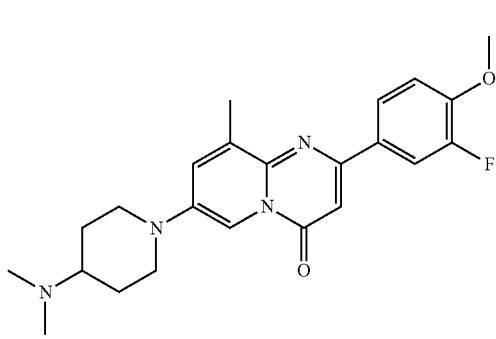
329
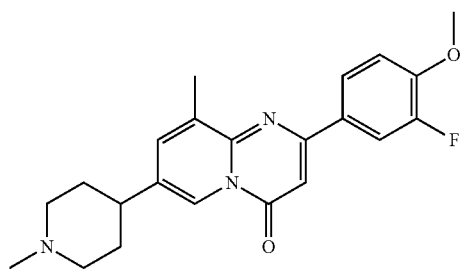
330
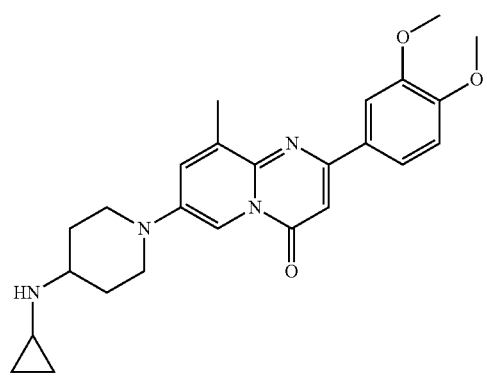
331
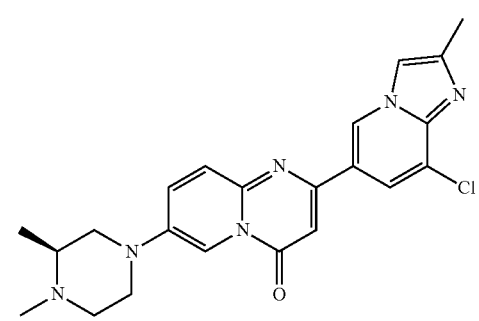
332
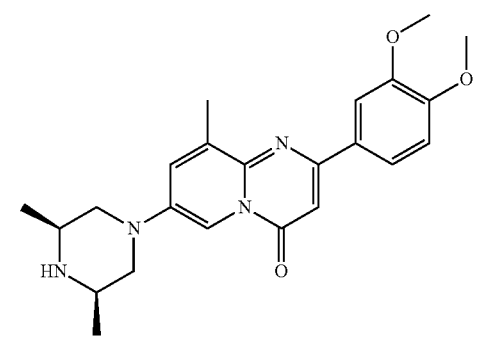
333
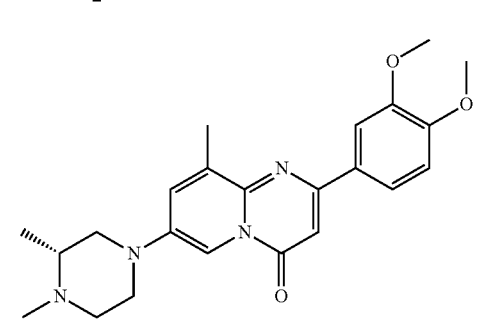

334 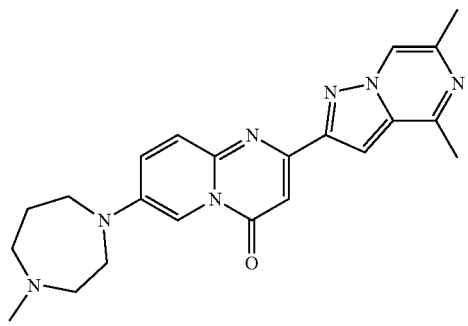
335 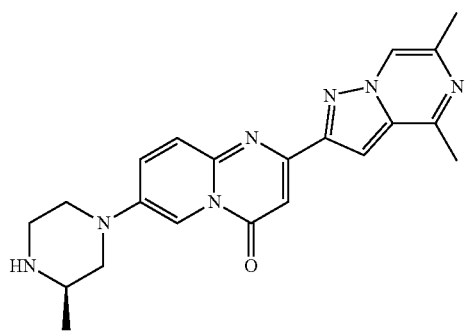
336 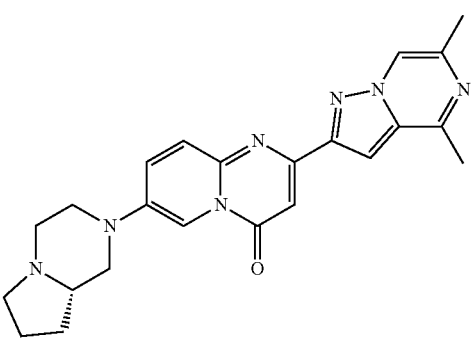
337 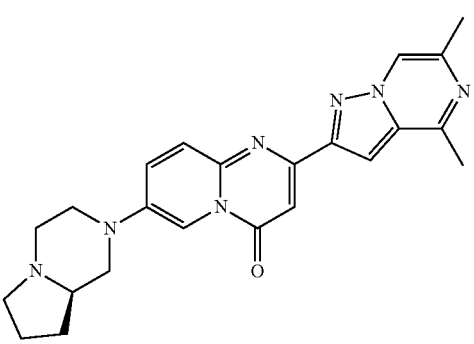
338 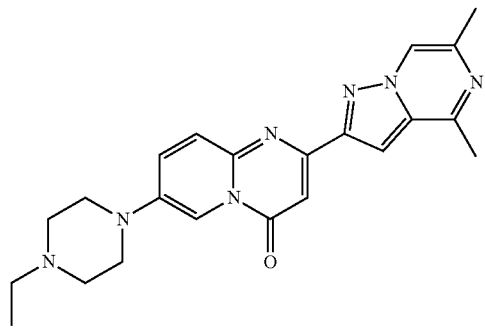
339 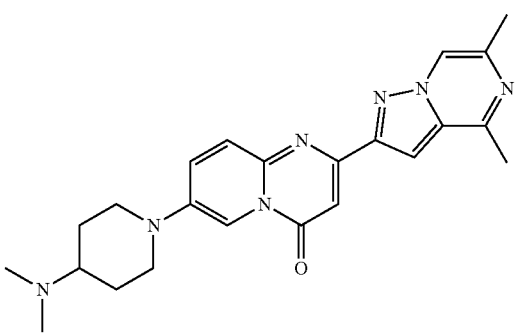
340 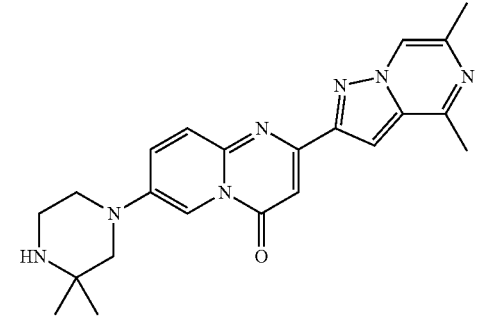
341 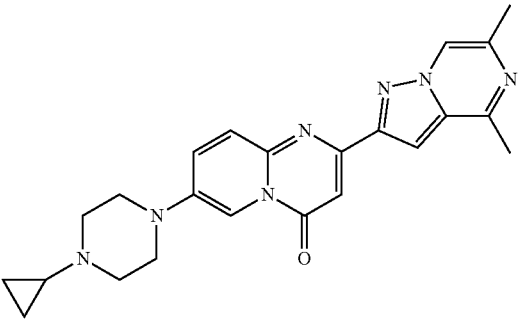

301
-continued
342
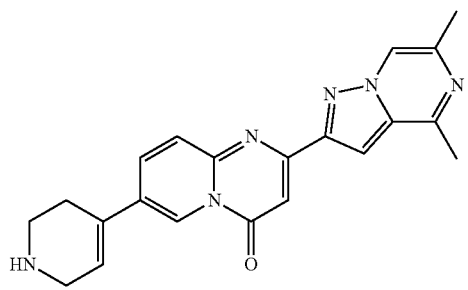
343
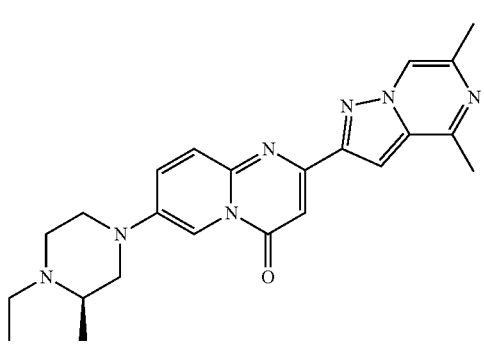
344
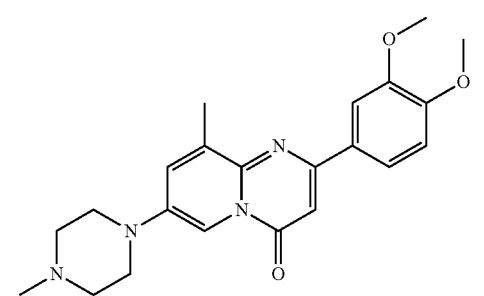
345
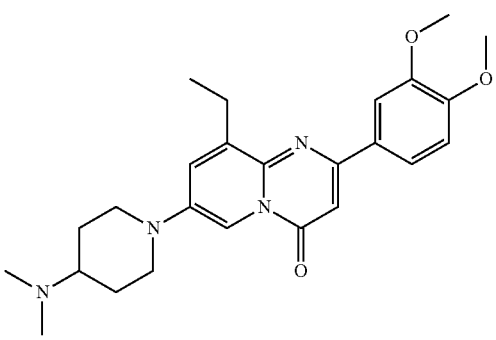
346
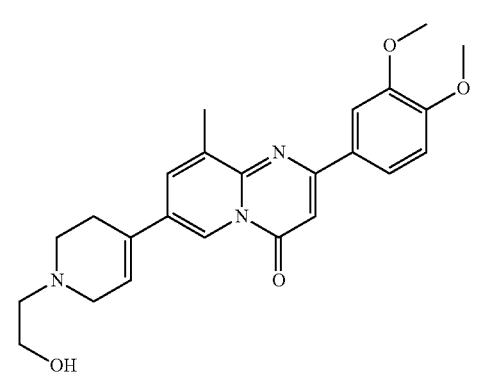
302
-continued
347
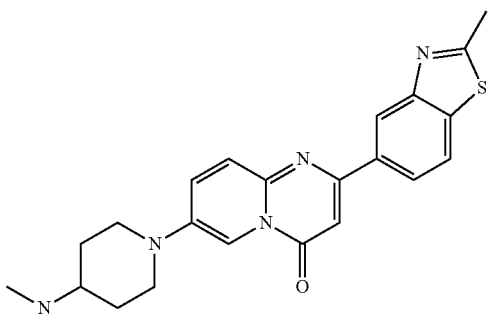
348
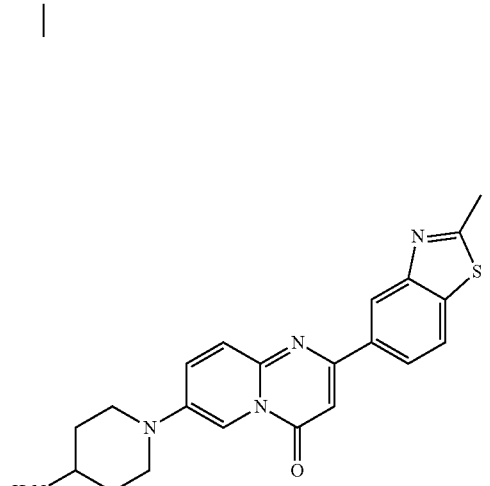
349
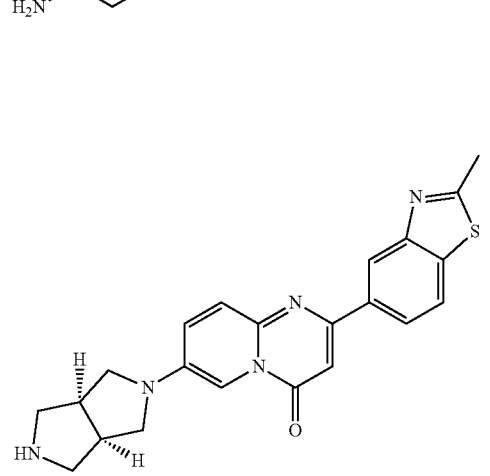
350
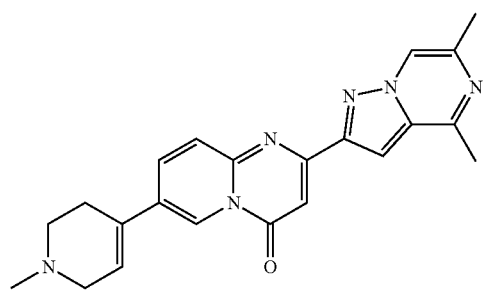

303
-continued
351
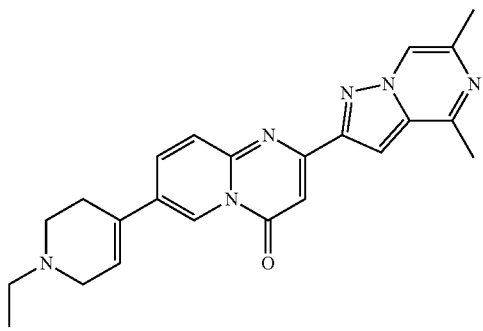
352
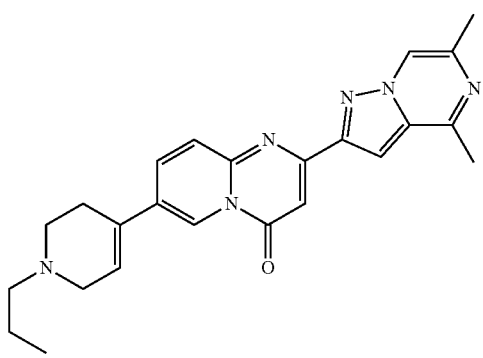
353
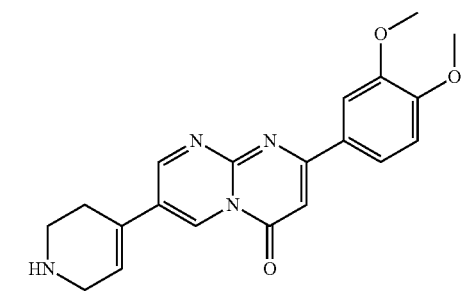
354
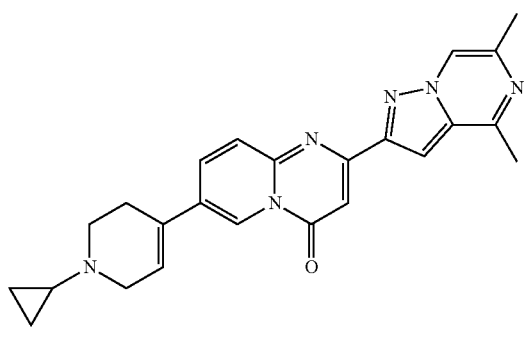
304
-continued
355
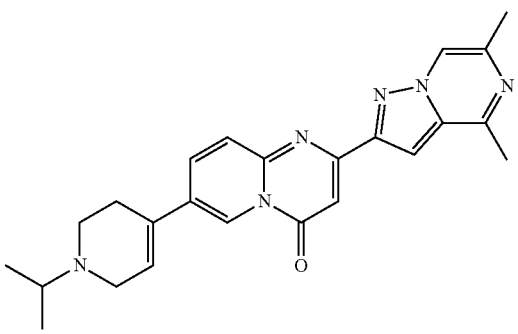
356
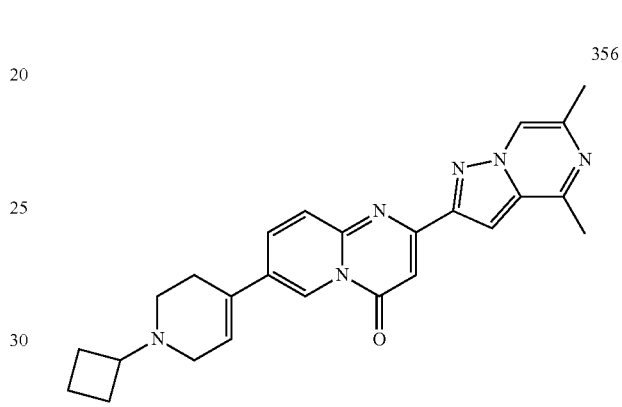
357
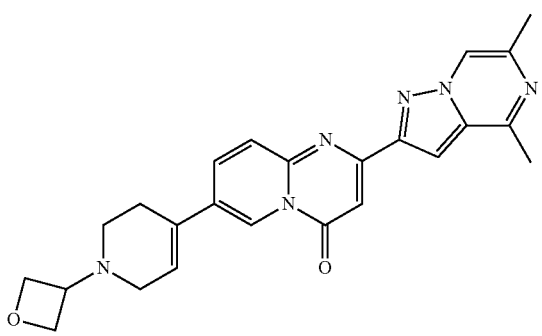
358
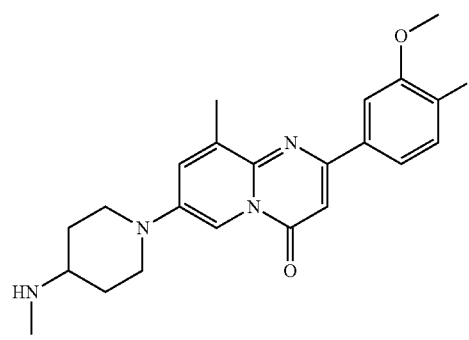

359
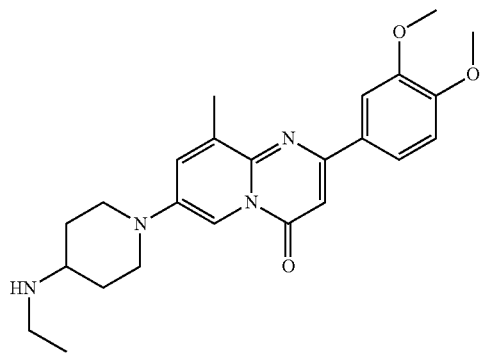
360
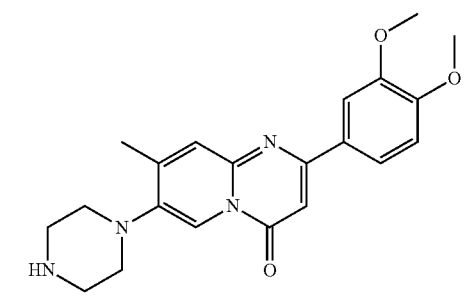
361
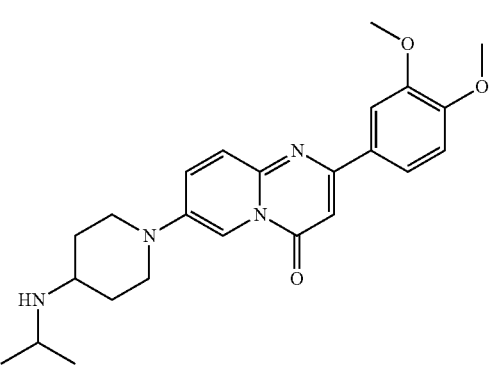
362
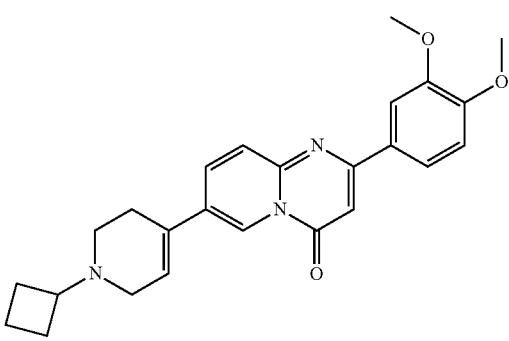
363
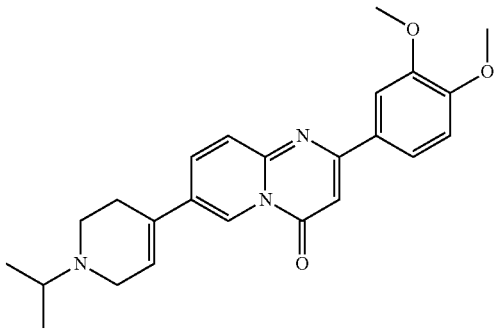
364
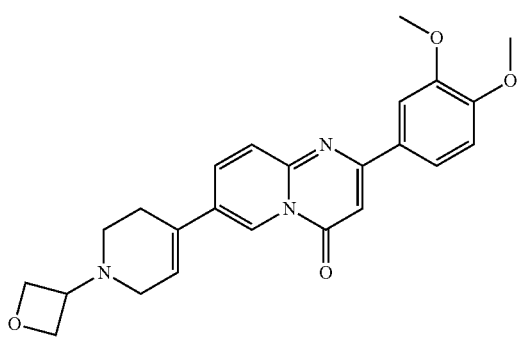
365
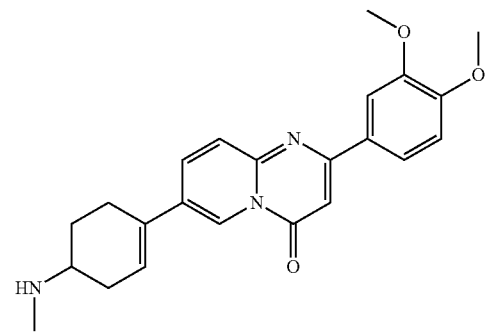
366

307
-continued
367
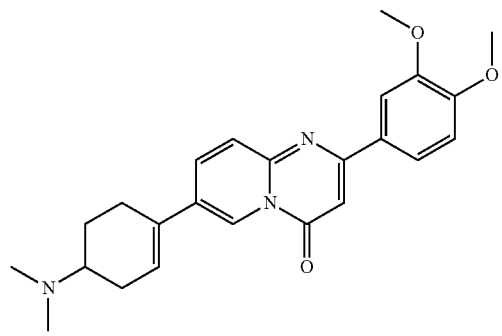
368
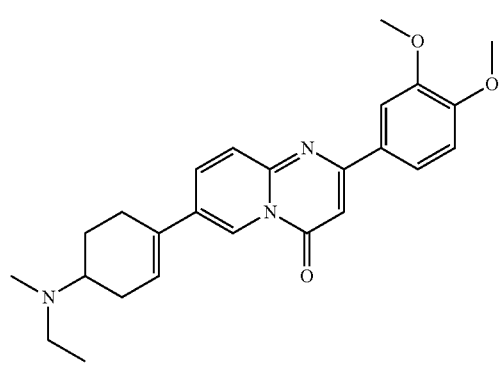
369
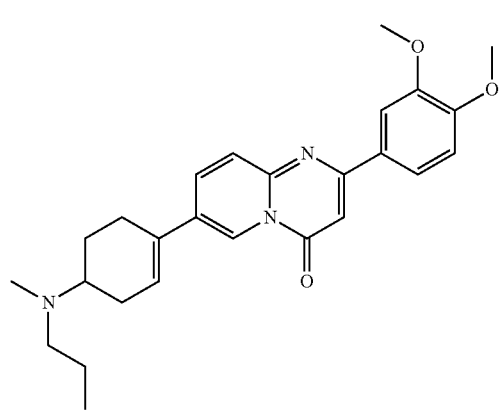
370
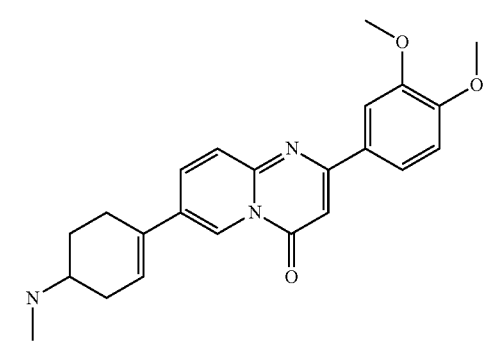
308
-continued
371
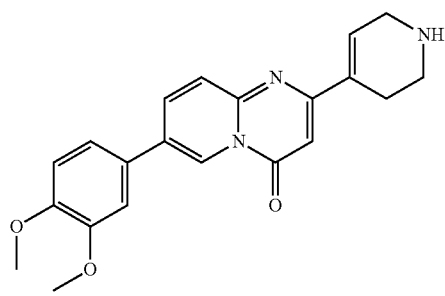
372
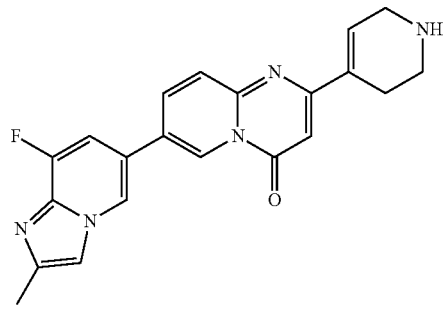
373
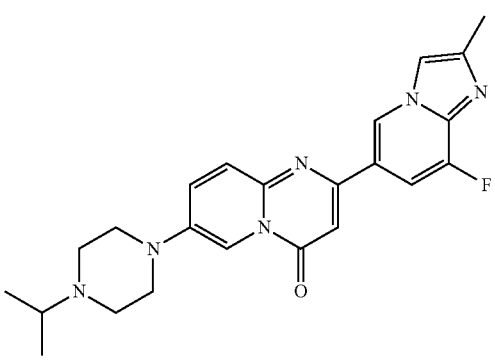
374
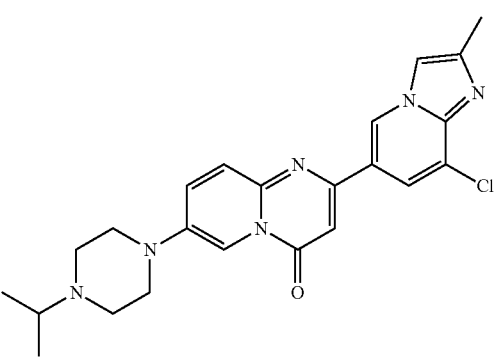

375 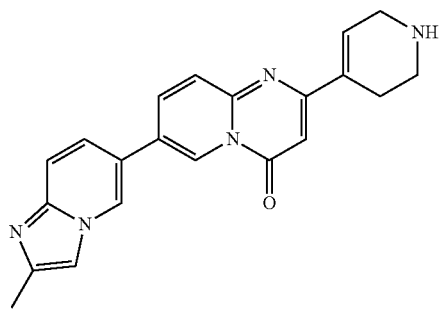
376 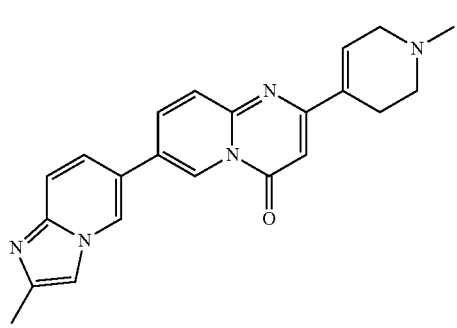
377 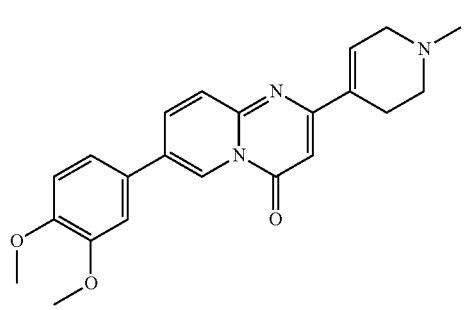
378 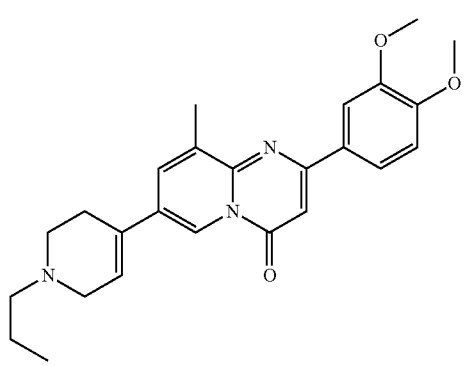
379 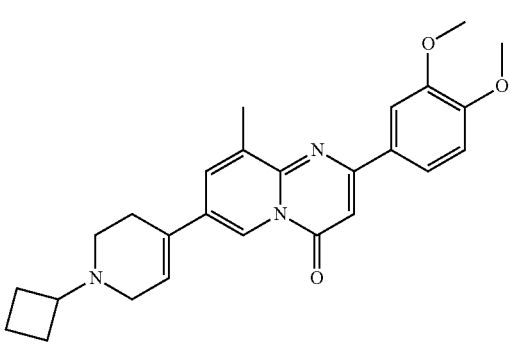
380 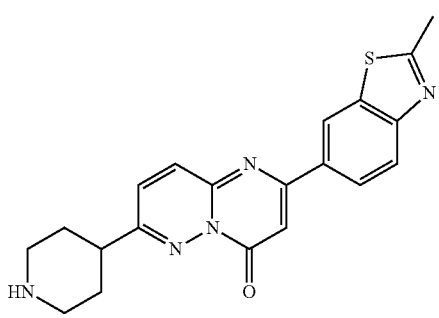
381 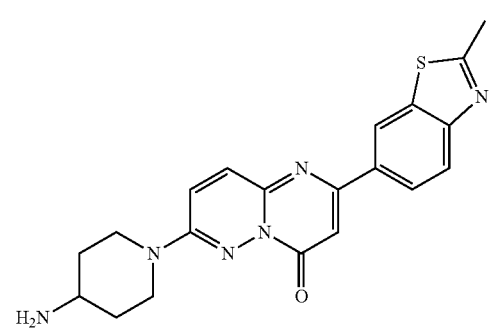
382 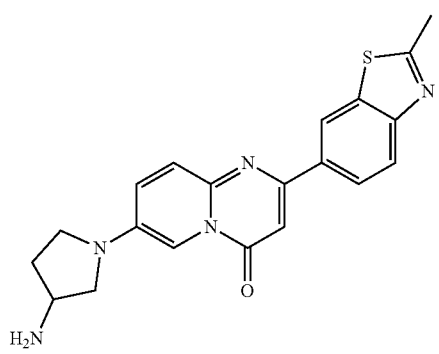

| 383 | 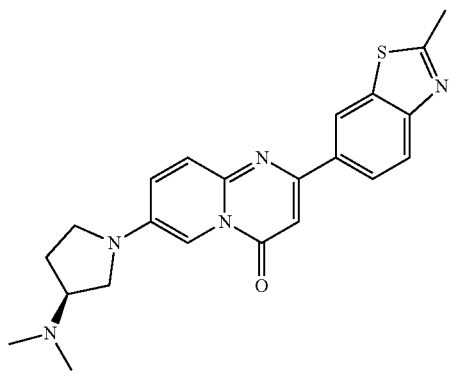 | 387 | 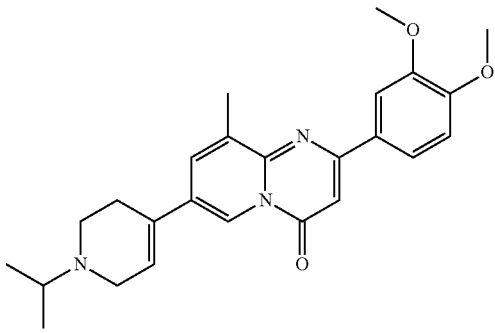 |
| 384 | 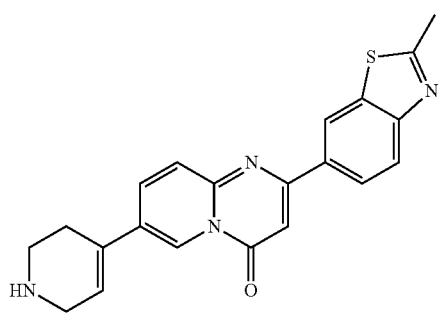 | 388 | 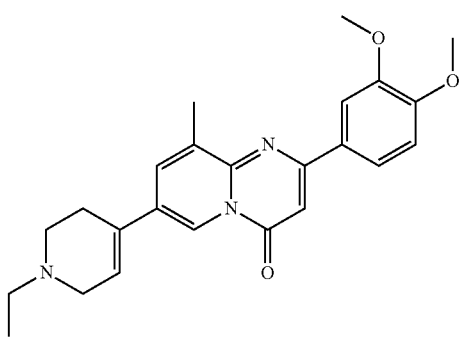 |
| 385 | 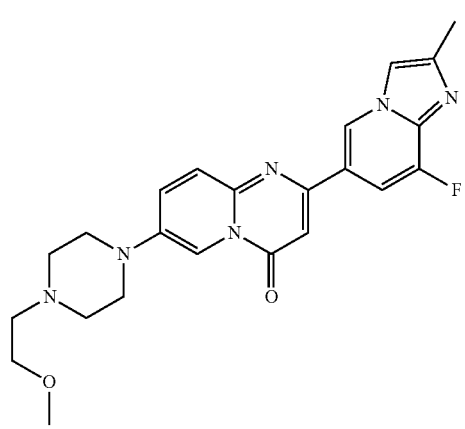 | 389 | 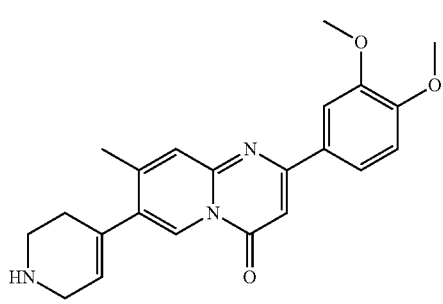 |
| 386 | 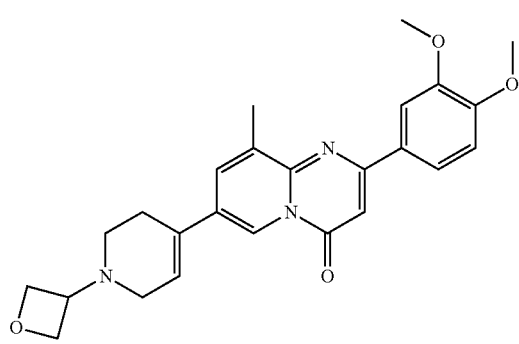 | 390 | 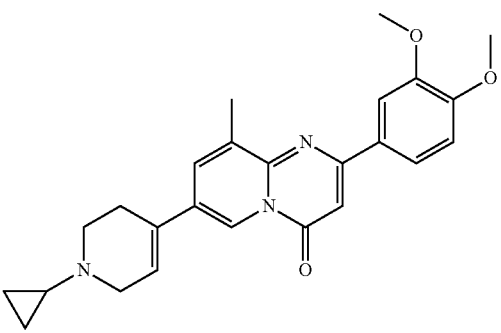 |

391 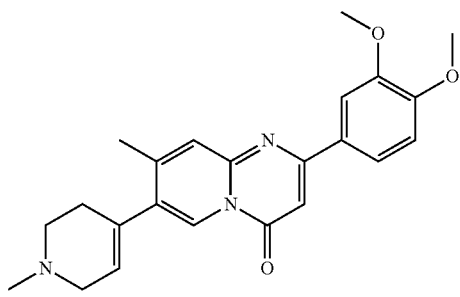
392 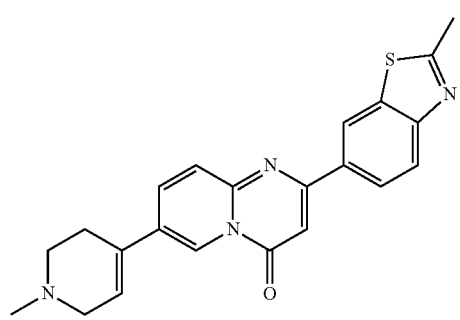
395 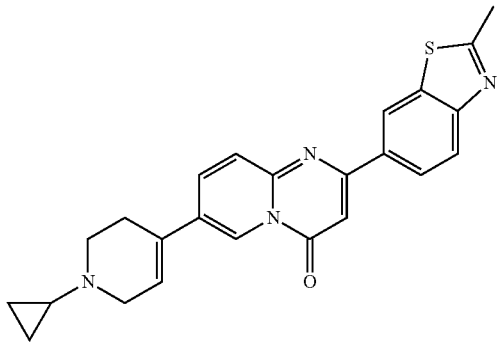
396 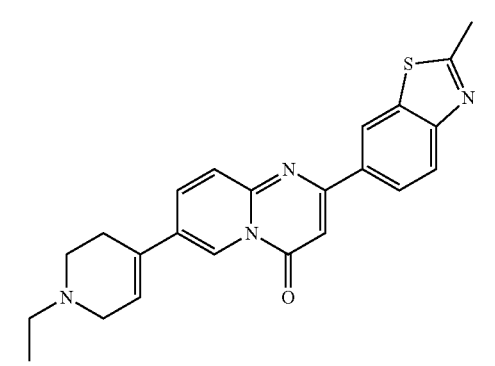
397 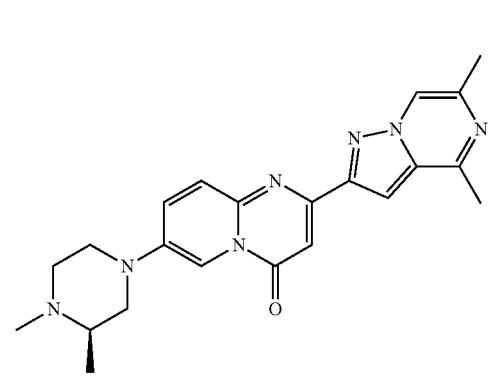
393 394 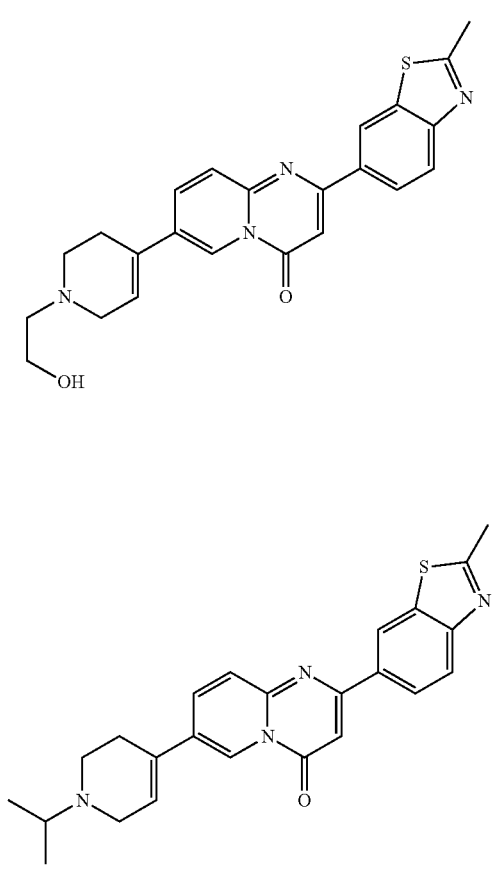
398 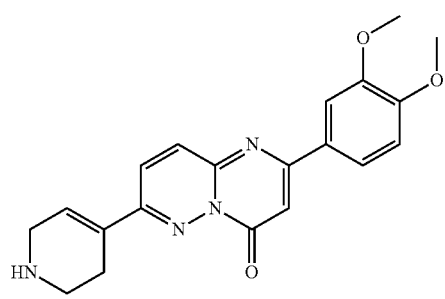

315
-continued
399
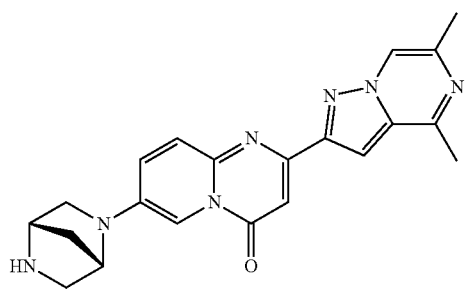
400
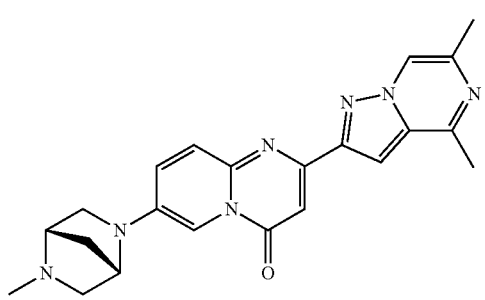
401
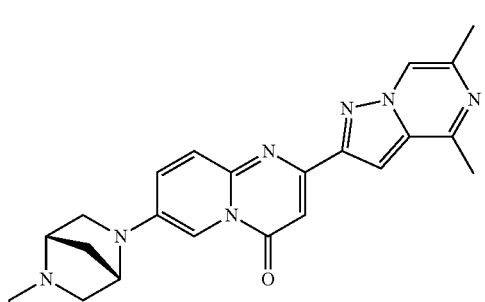
402
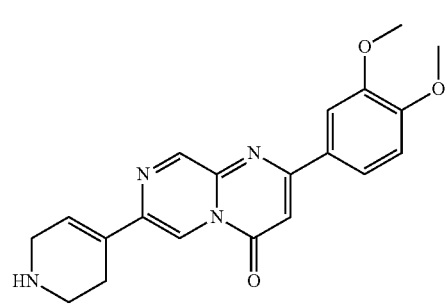
403
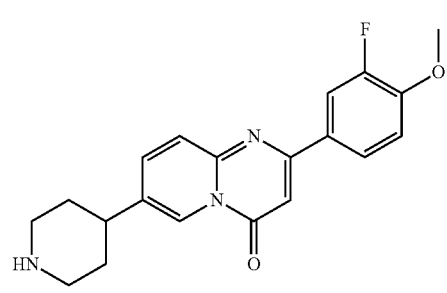
316
-continued
404
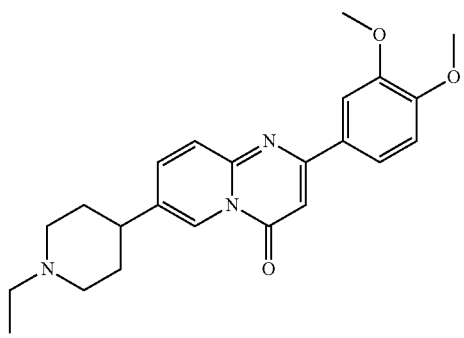
405
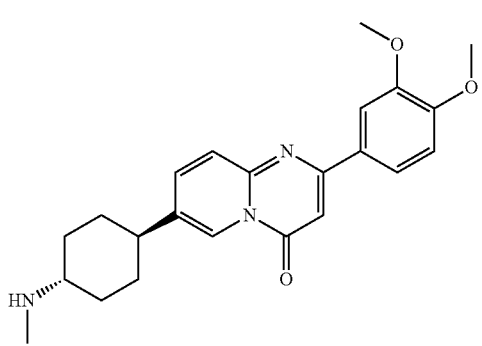
406
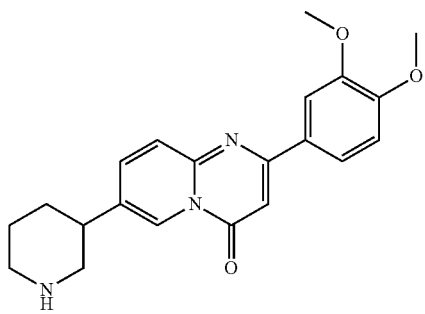
407
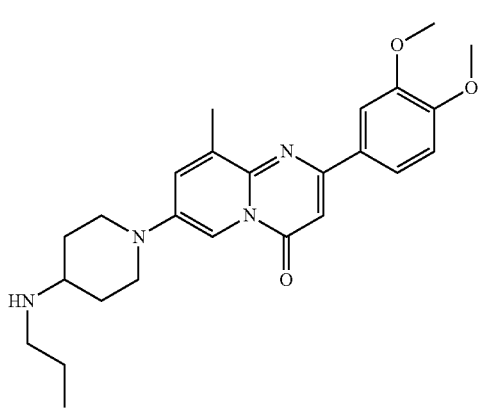

-continued
408 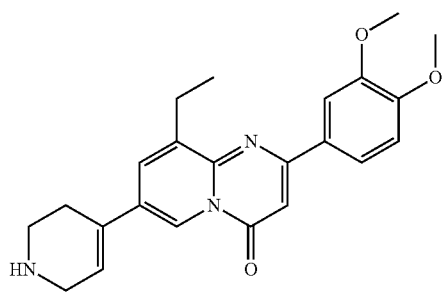
409 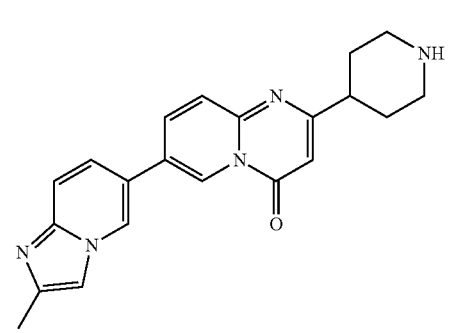
410 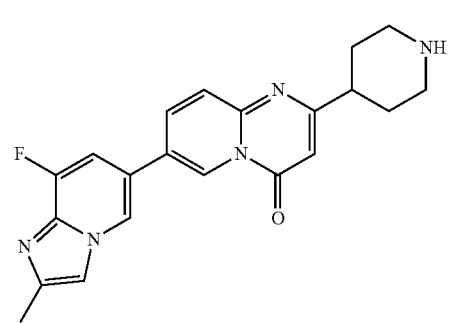
411 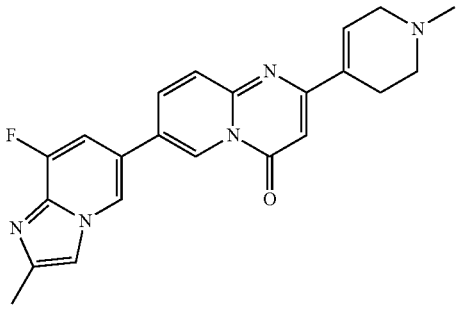
412 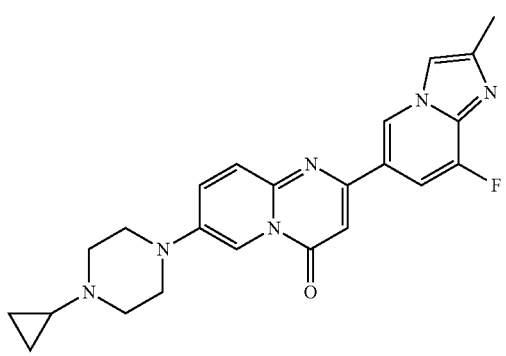
-continued
413 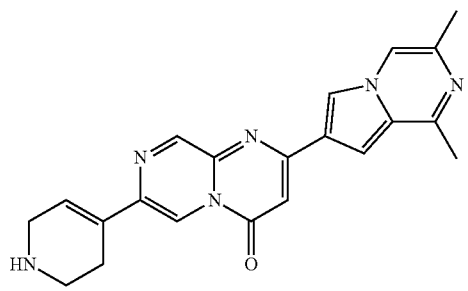
414 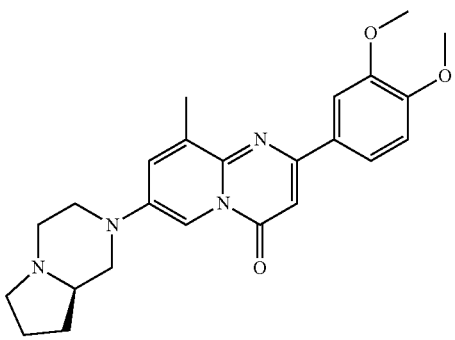
415 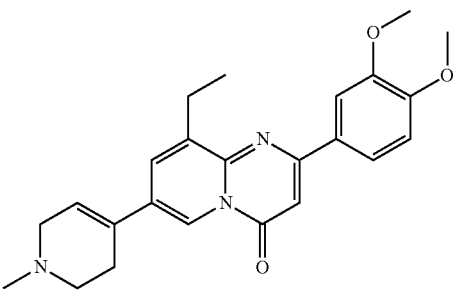
416 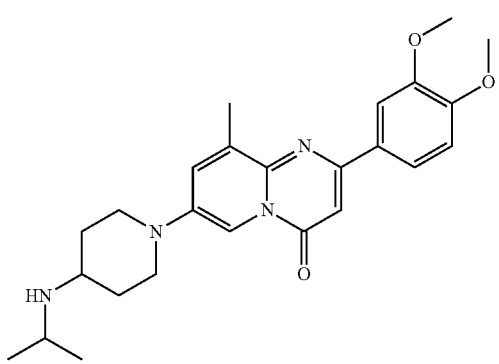
417 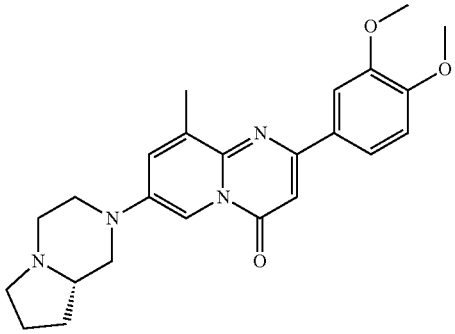

| 418 | 423 |
|---|---|
| 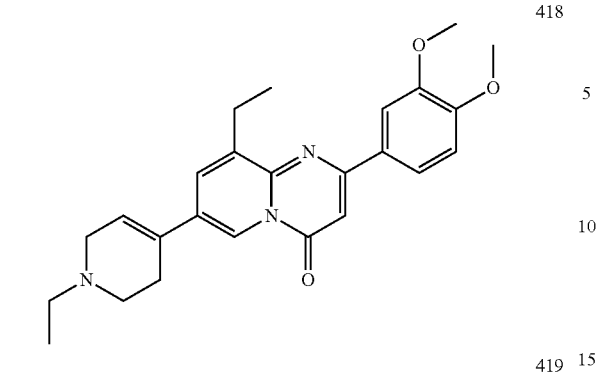 |  |
| 419 | 424 |
| 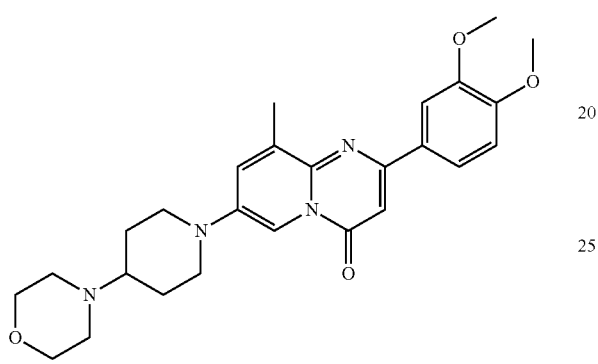 | 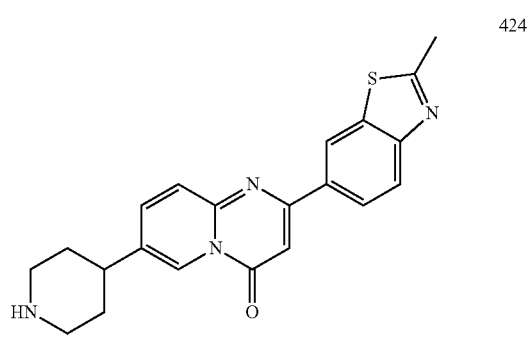 |
| 420 | 425 |
| 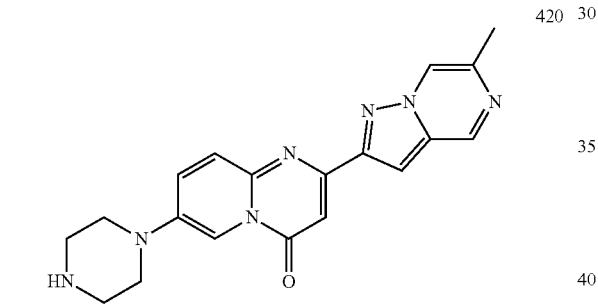 | 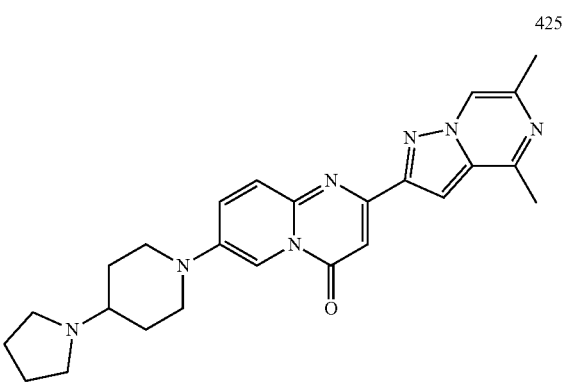 |
| 421 | 426 |
| 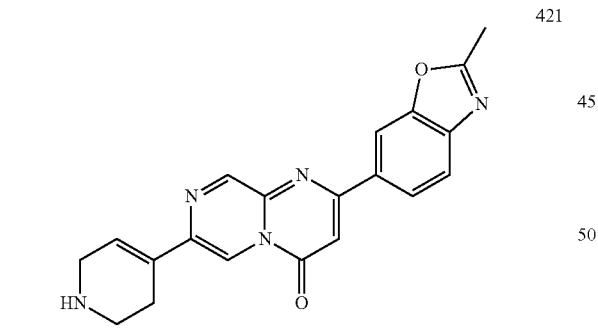 | 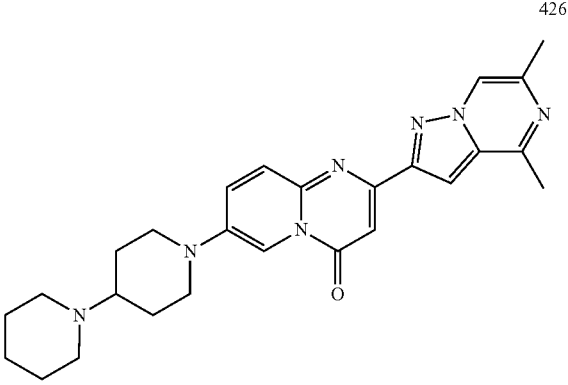 |
| 422 | |
| 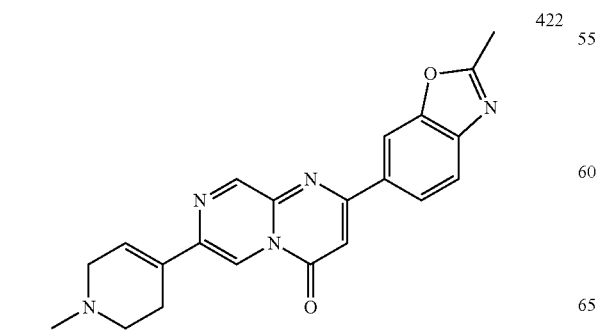 | |

-continued
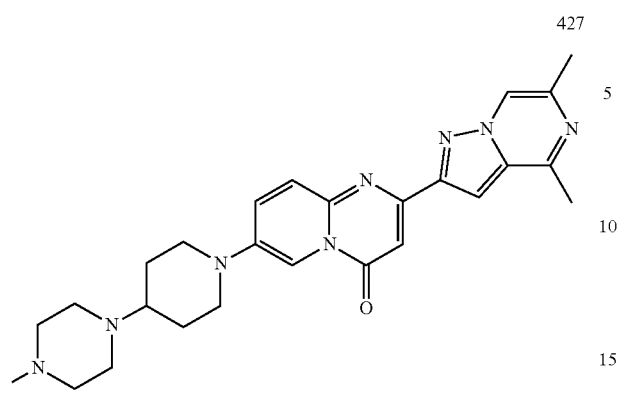
427
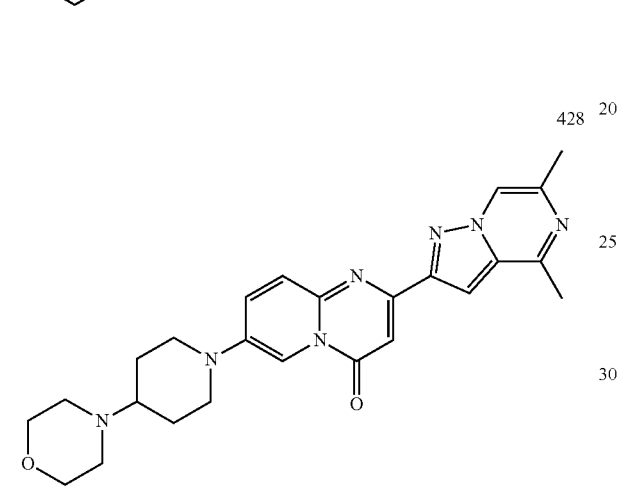
428
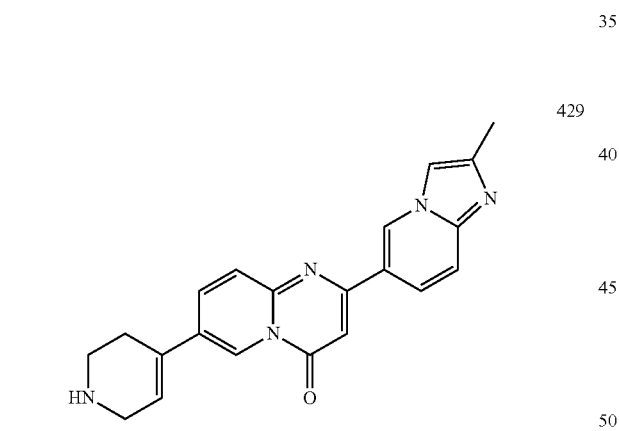
429
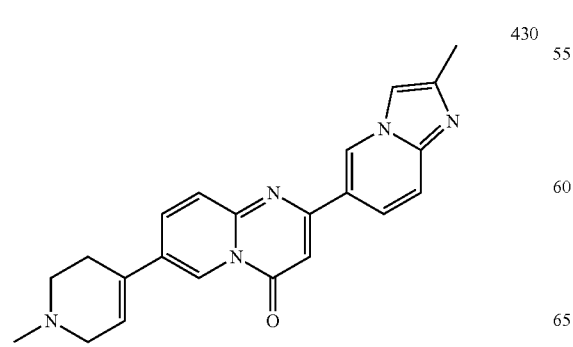
430
-continued
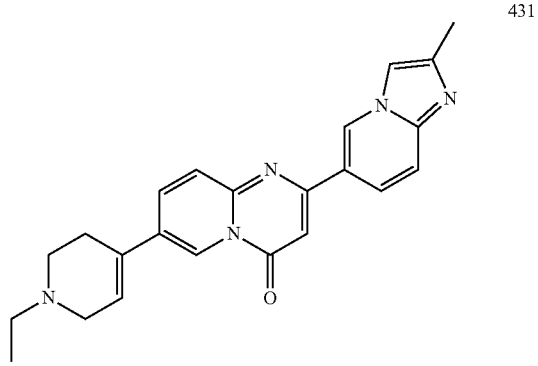
431
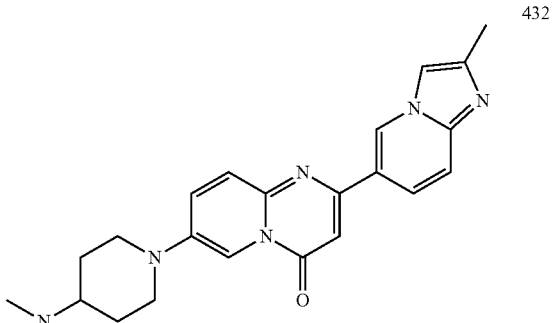
432
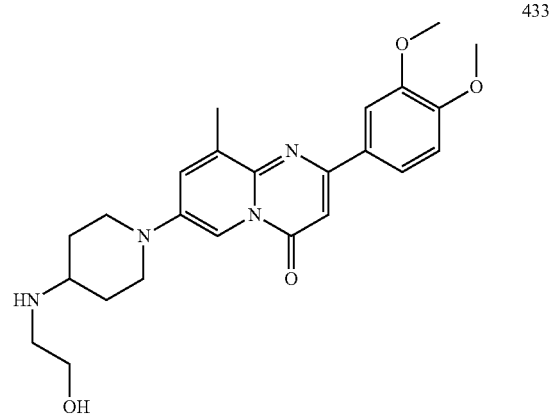
433
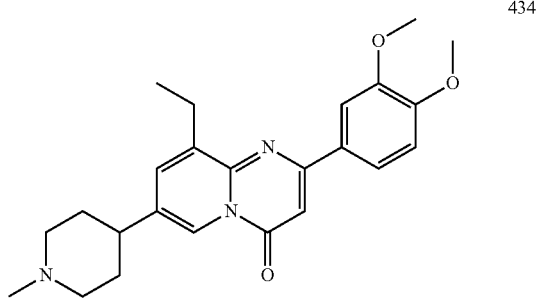
434

435
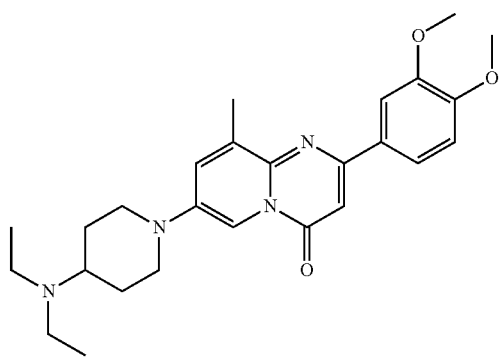
436
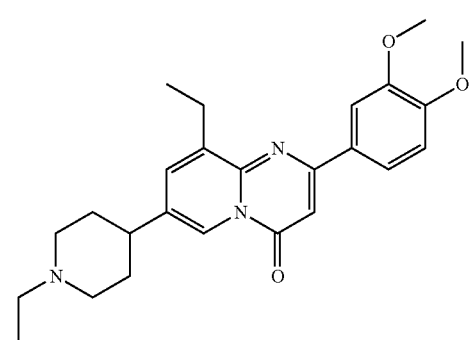
437
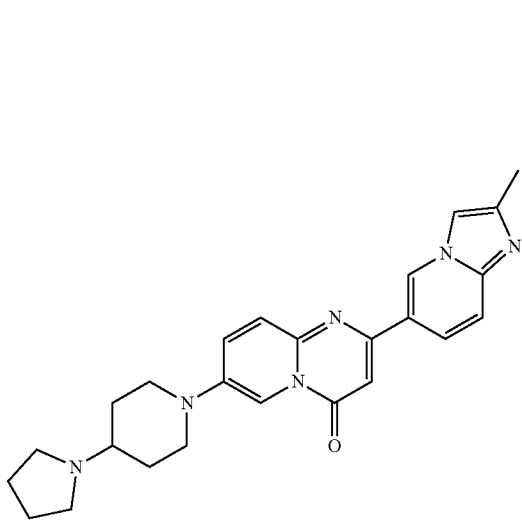
438
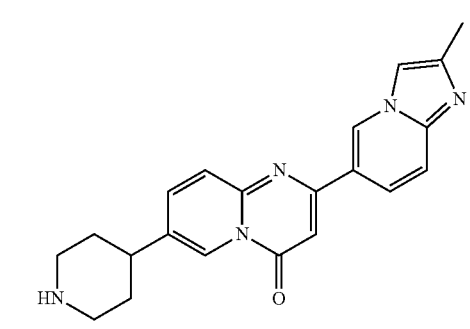
439
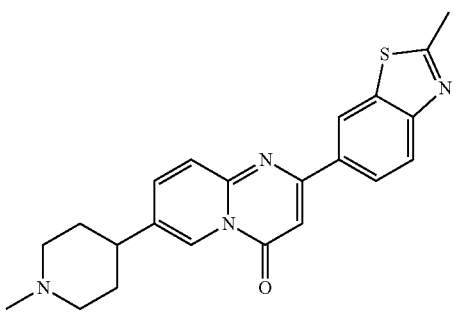
440
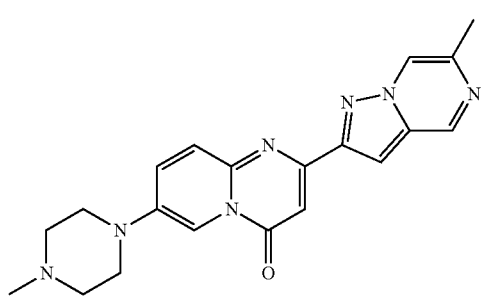
441
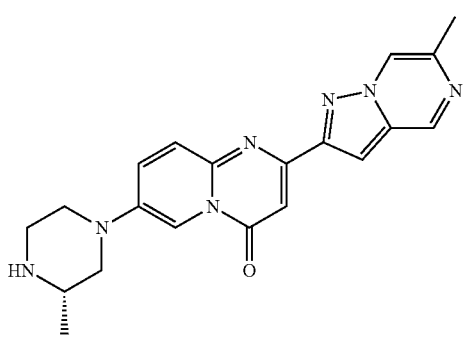
442
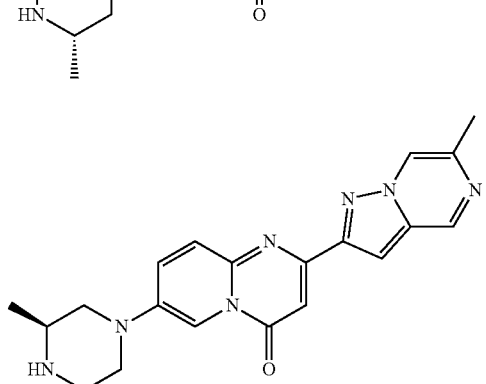
443
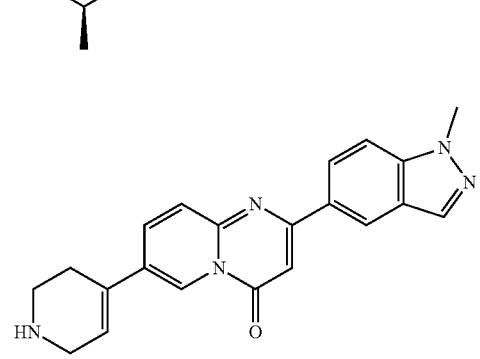

444
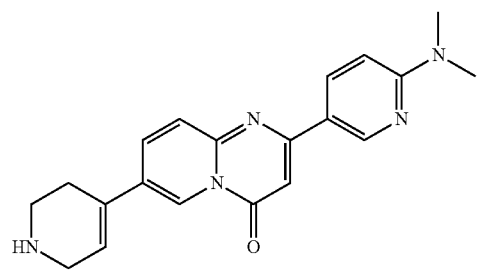
445
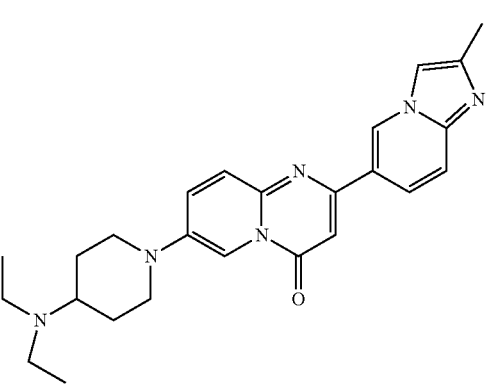
446
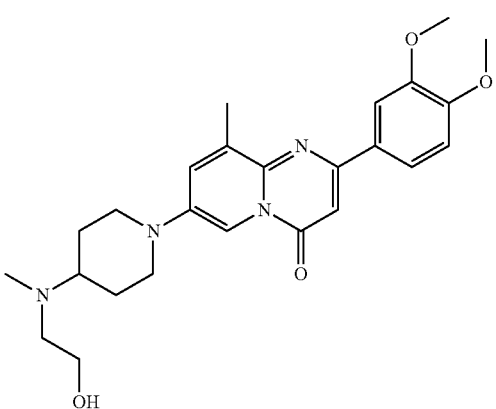
447
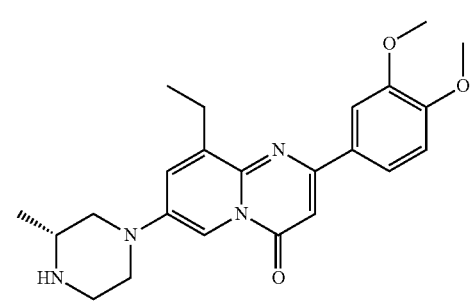
448
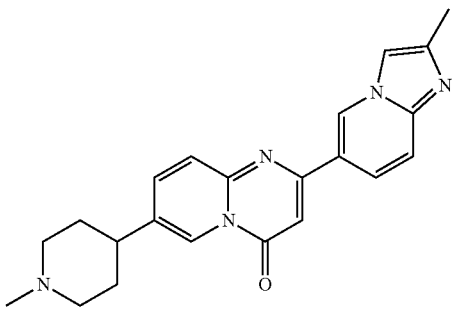
449
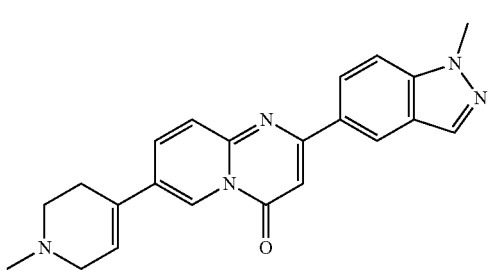
450
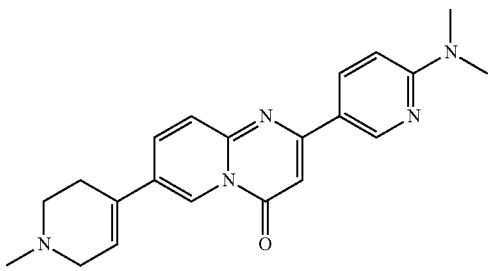
451
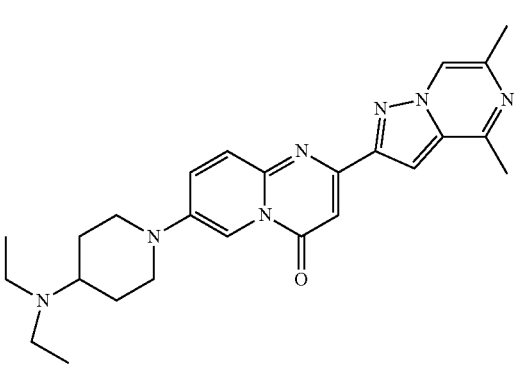
452
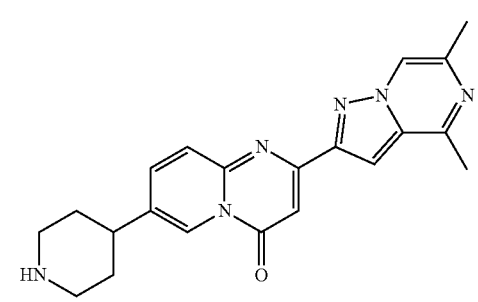

453
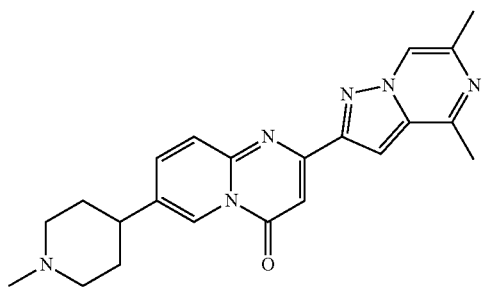
454
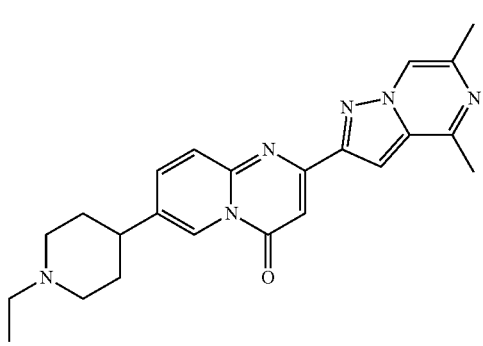
455
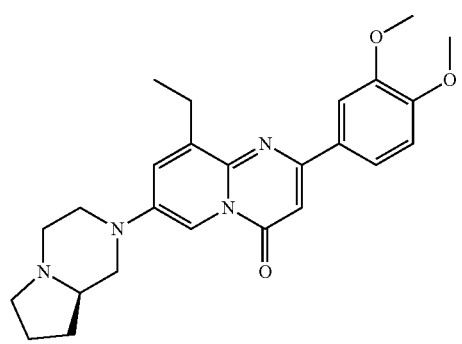
456
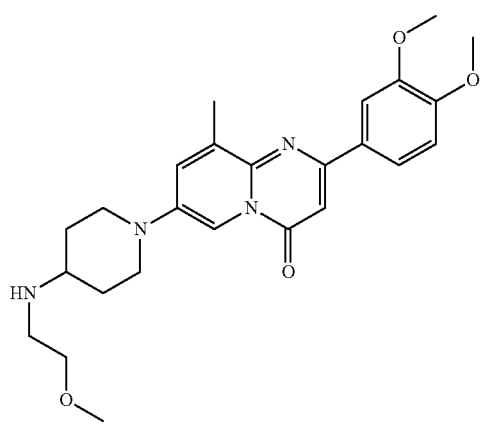
457
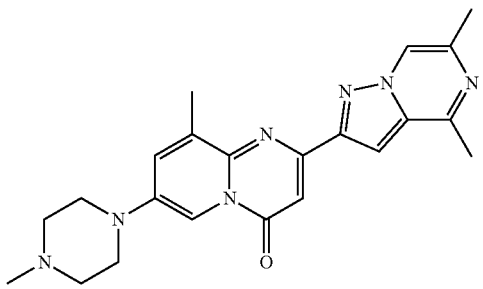
458
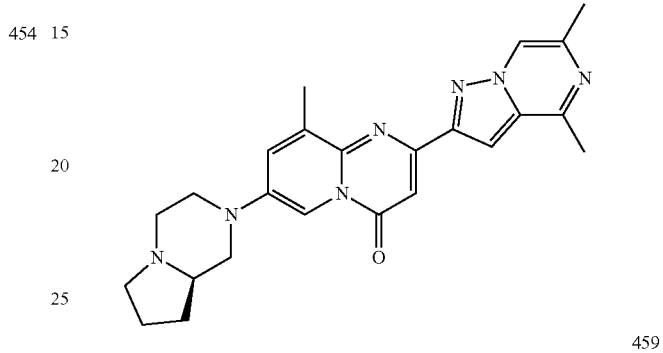
459
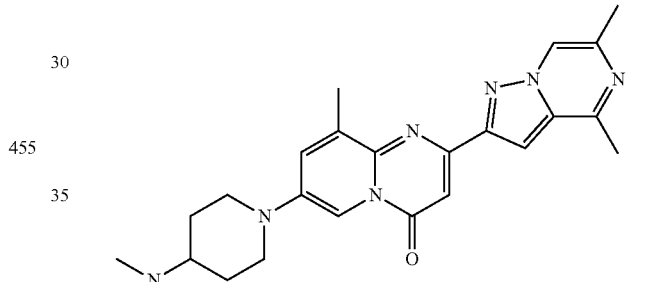
460
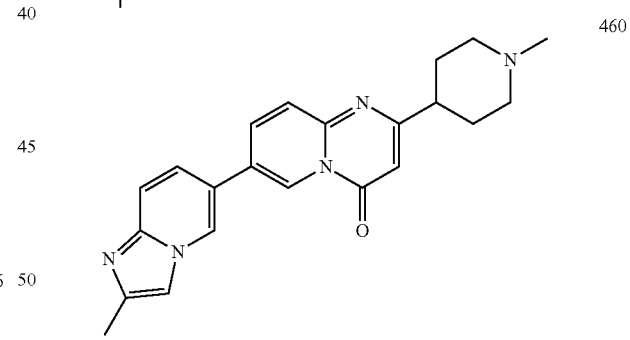
461
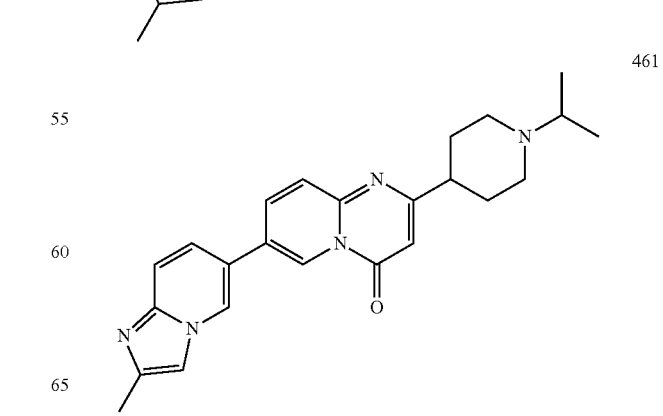

-continued
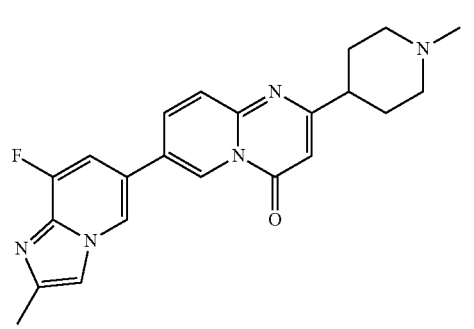
462
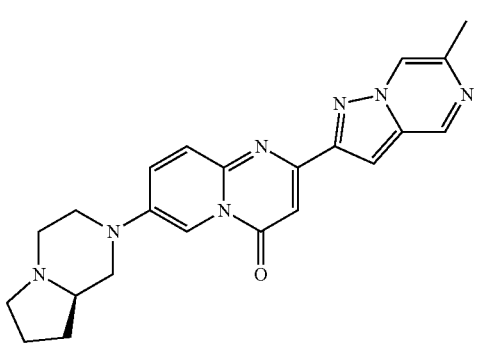
467
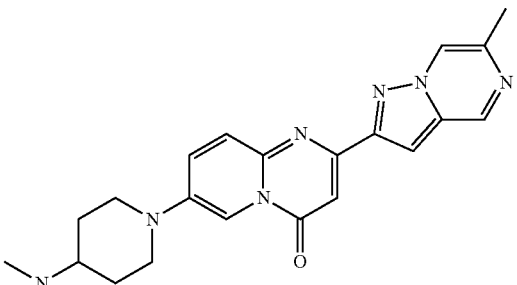
463
468
464
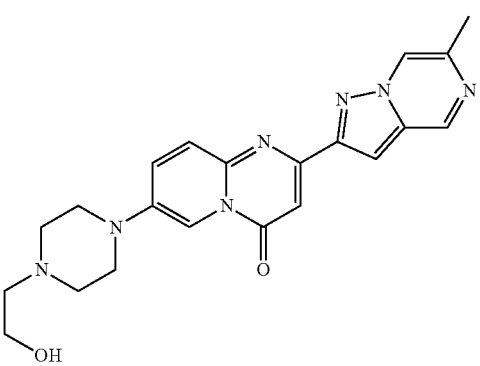
469
465
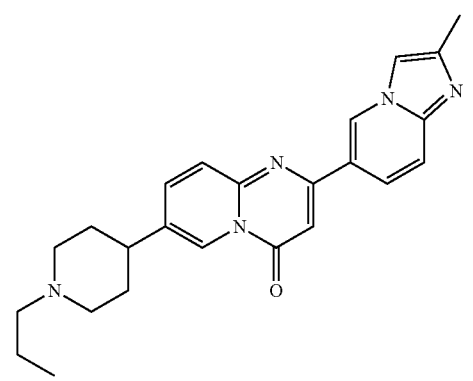
466
470

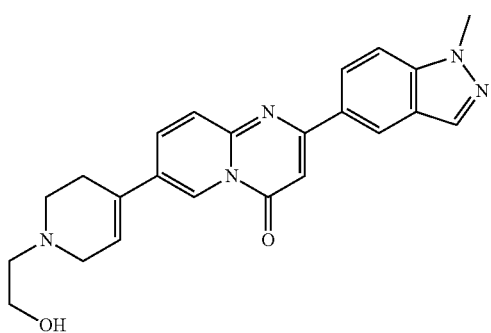
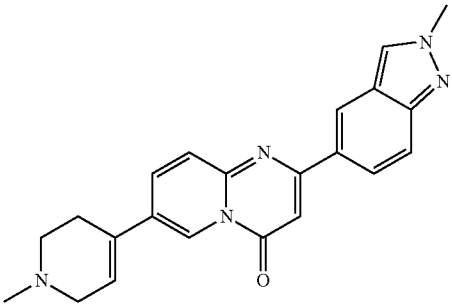
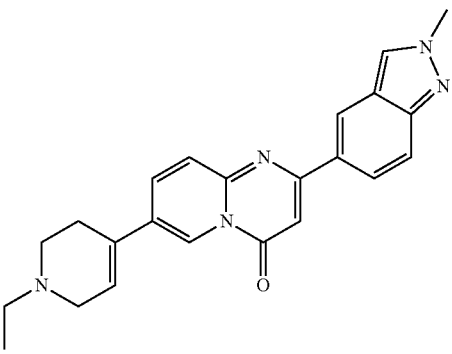
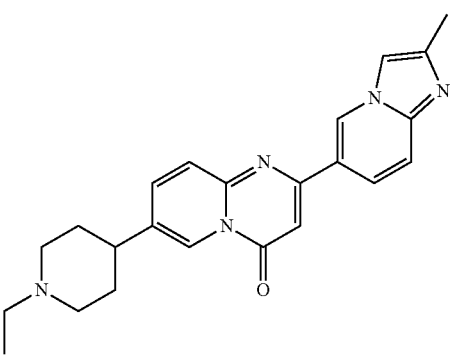
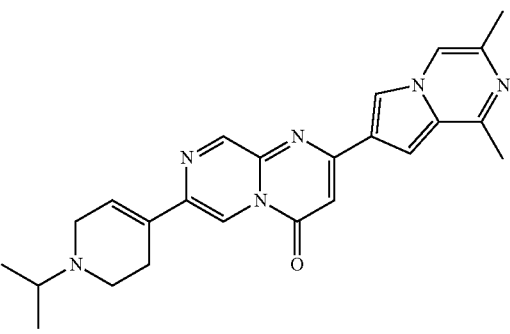

-continued
480
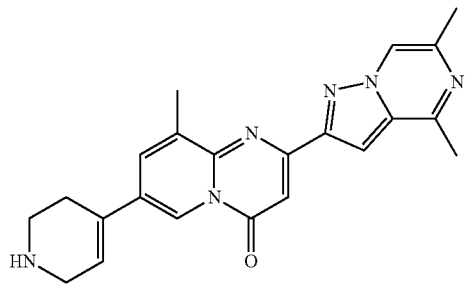
481
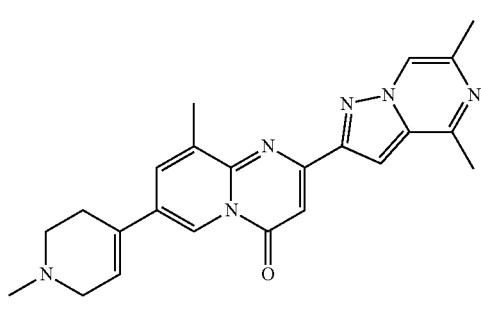
482
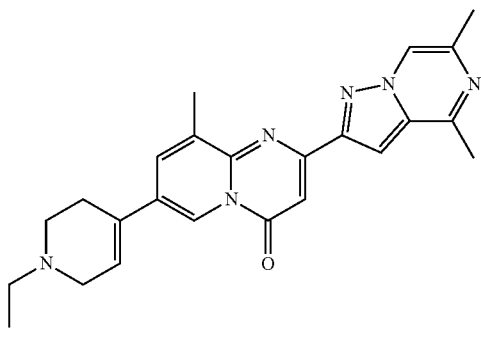
483
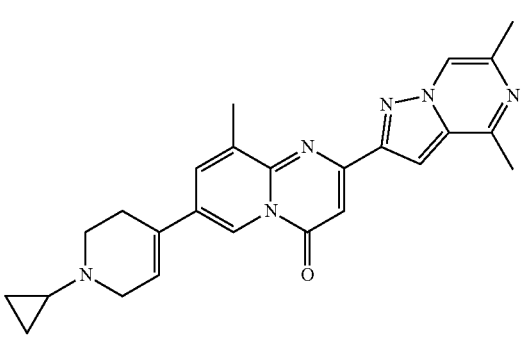
484
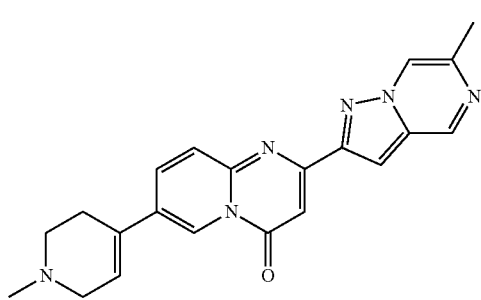
-continued
485
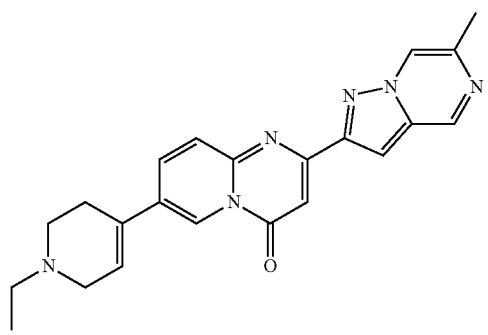
486
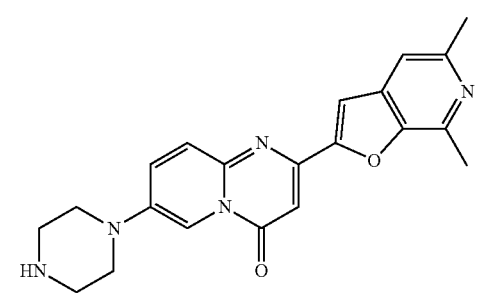
487
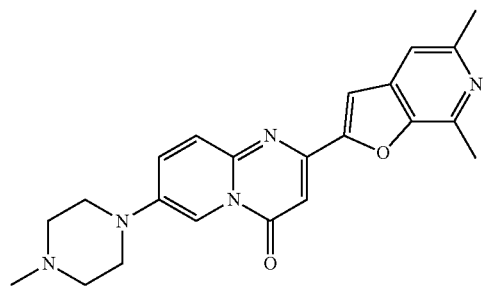
488
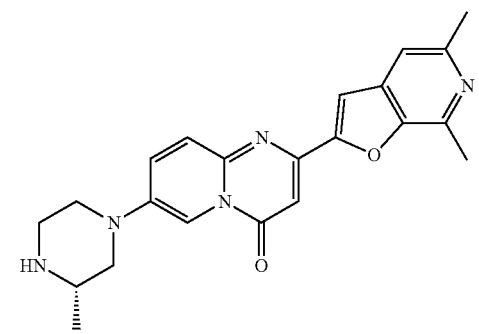
489
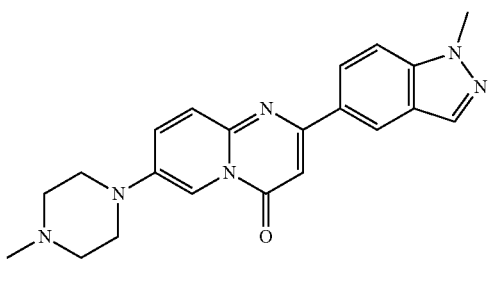

490
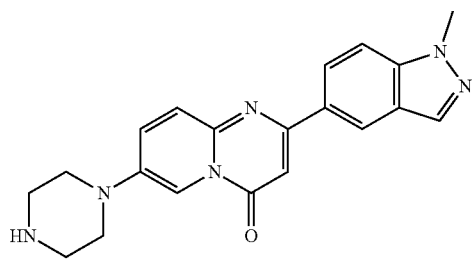
491
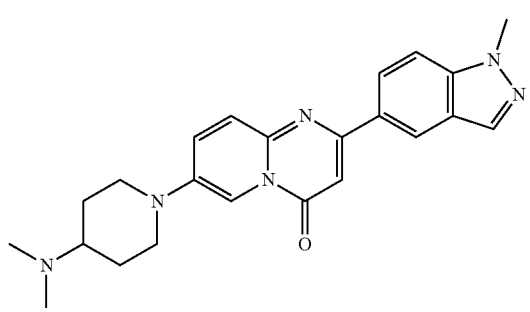
492
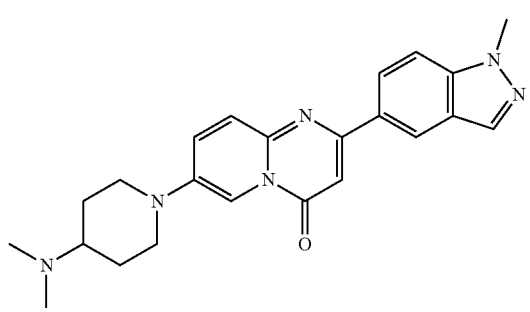
493
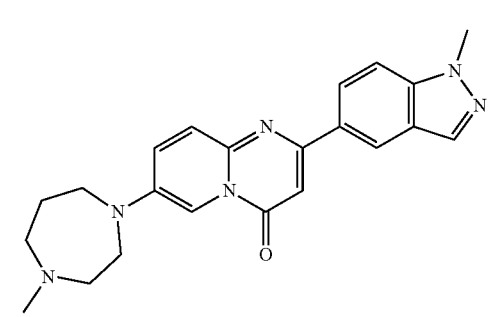
494
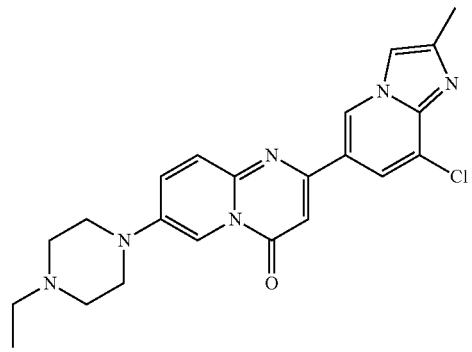
495
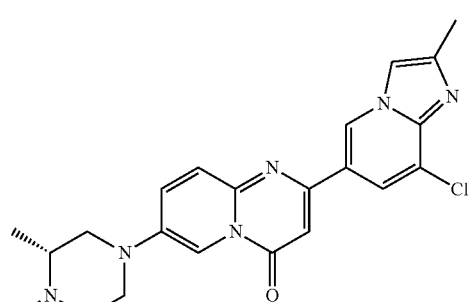
496
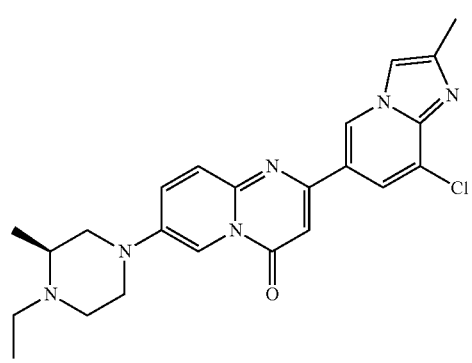
497
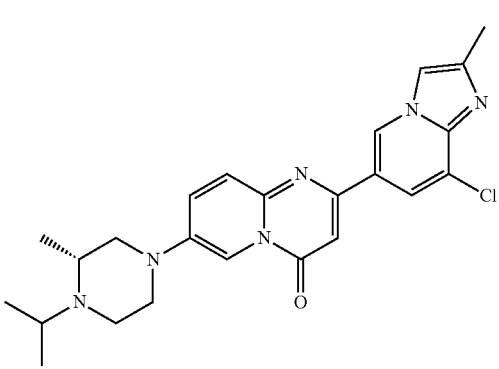

498 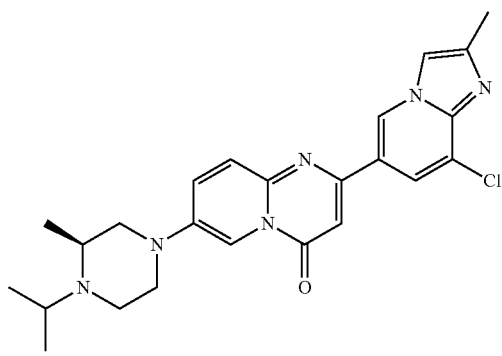
503 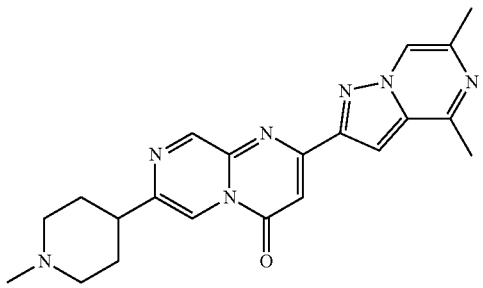
499 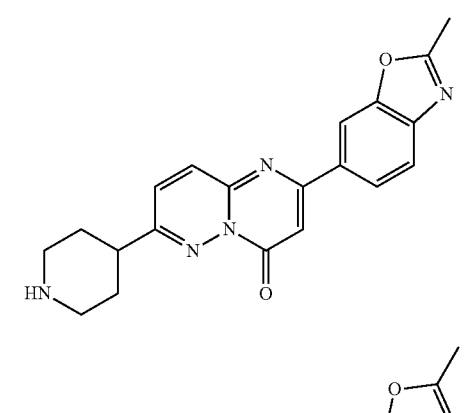
504 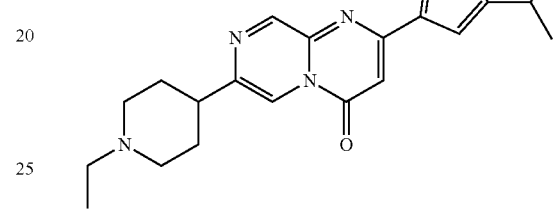
500 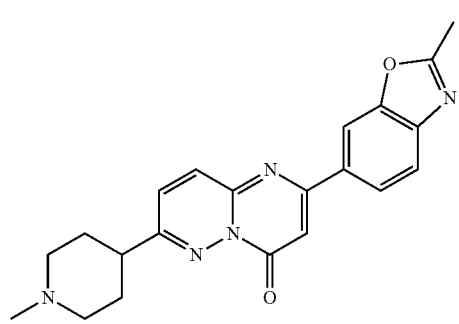
505 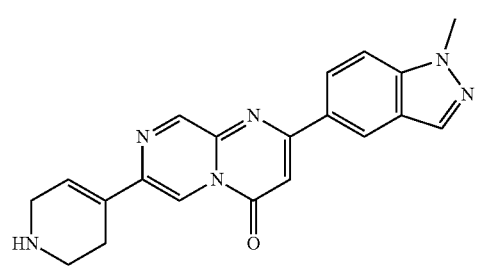
501 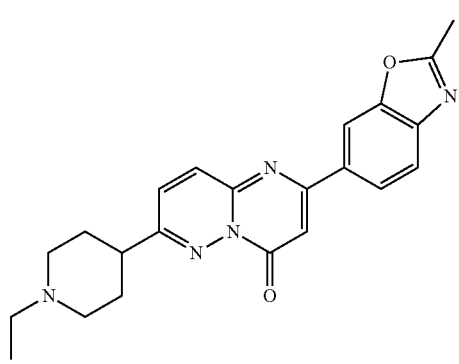
506 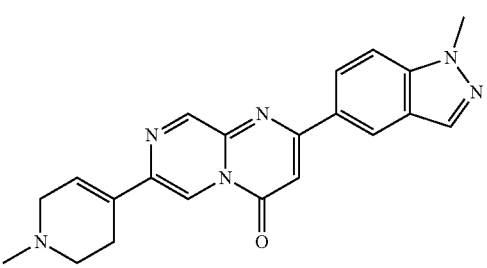
502 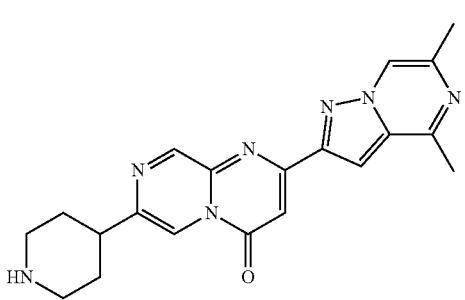
507 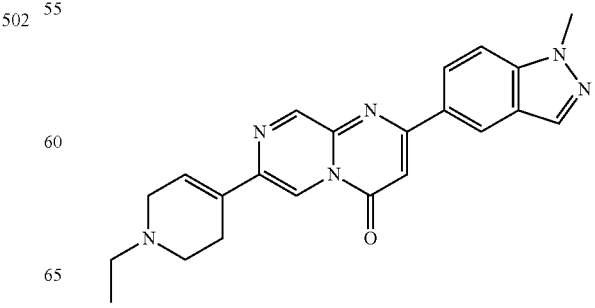

-continued
508
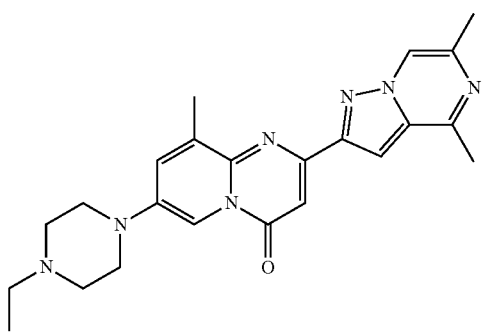
509
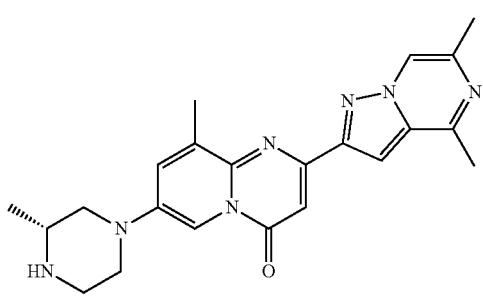
510
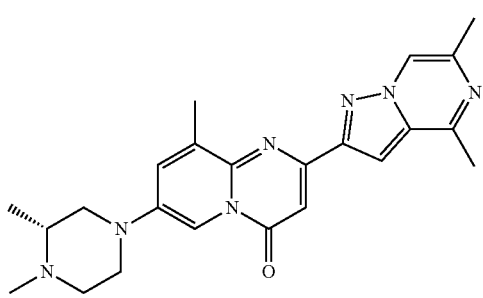
511
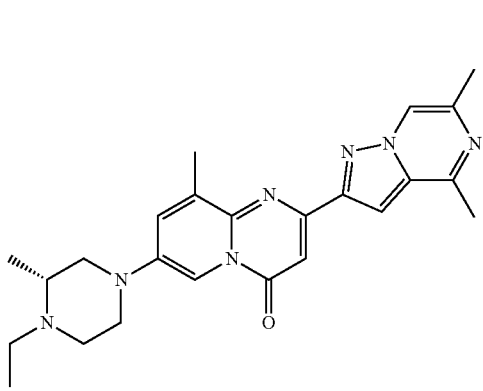
512
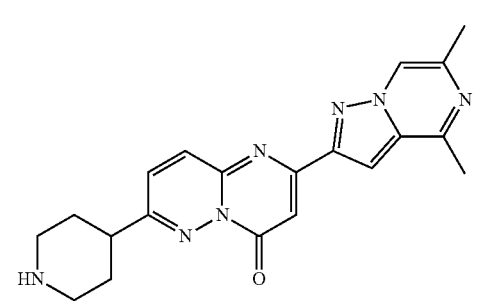
-continued
513
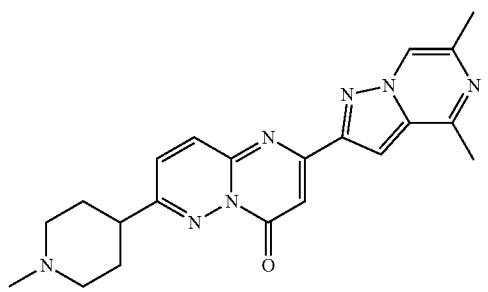
514
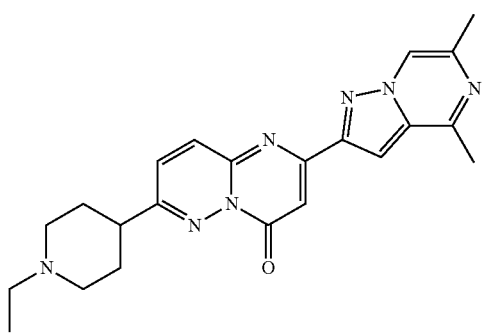
515
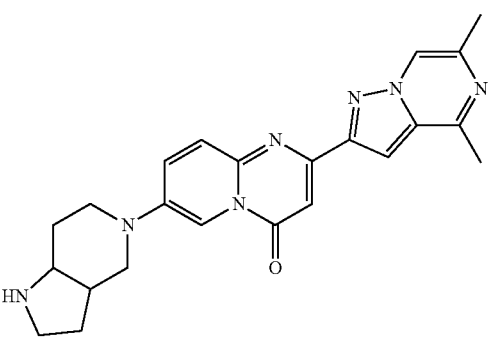
516
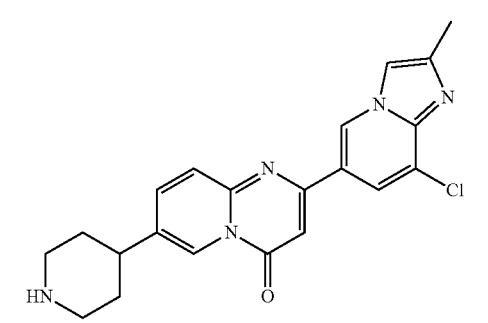
517
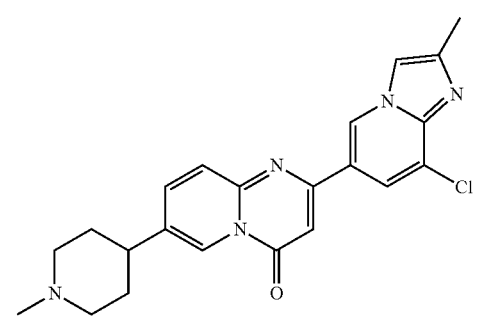

518 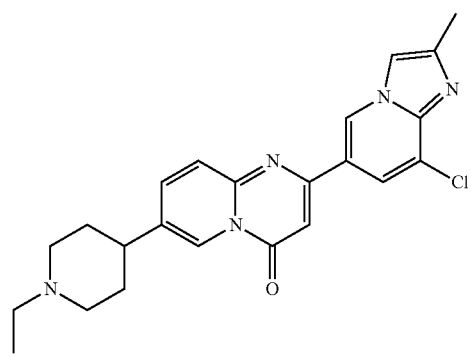
522 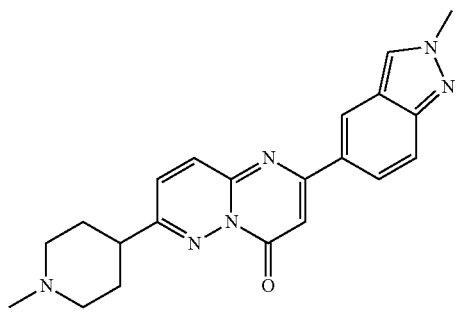
519 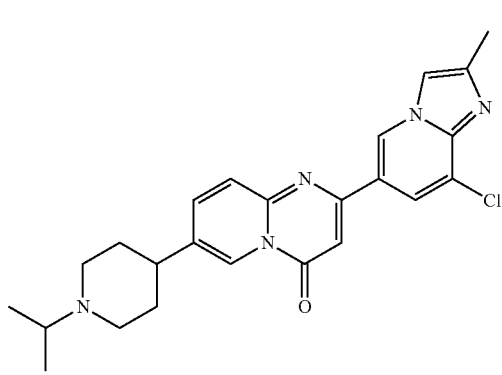
523 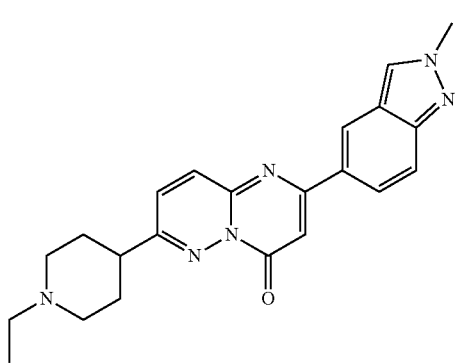
520 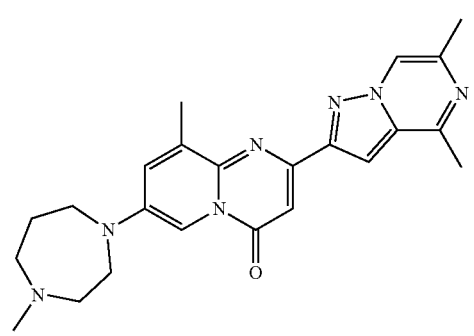
524 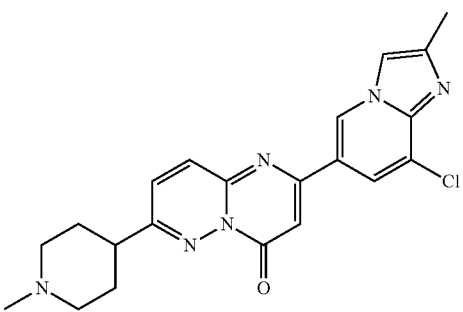
521 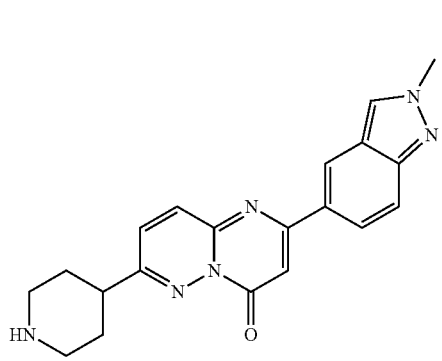
525 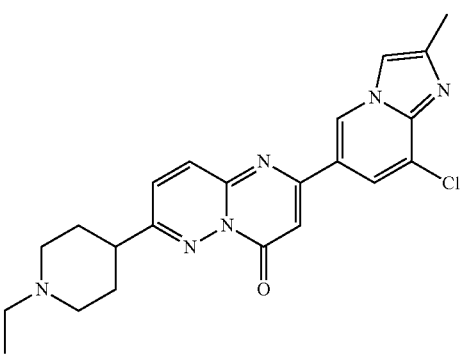

-continued
526
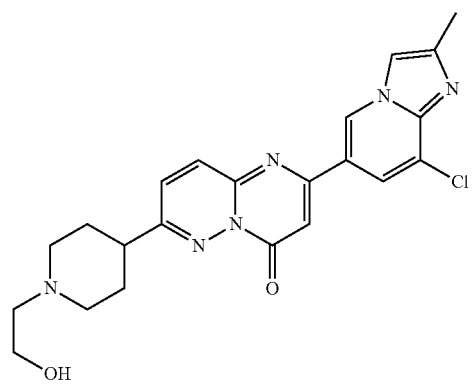
527
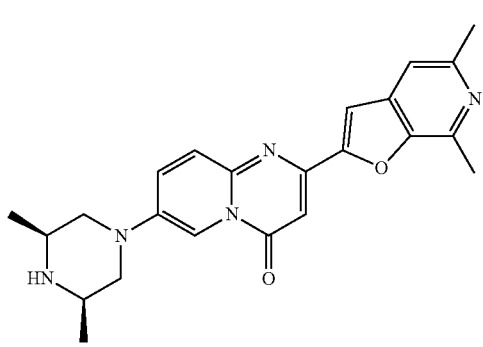
528
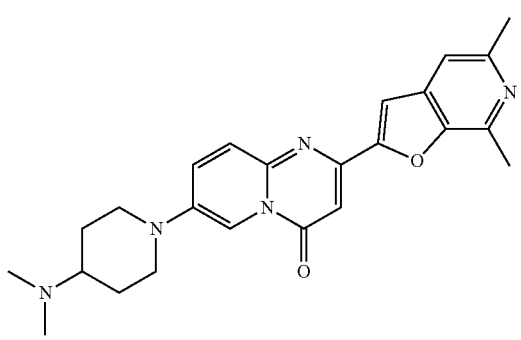
529
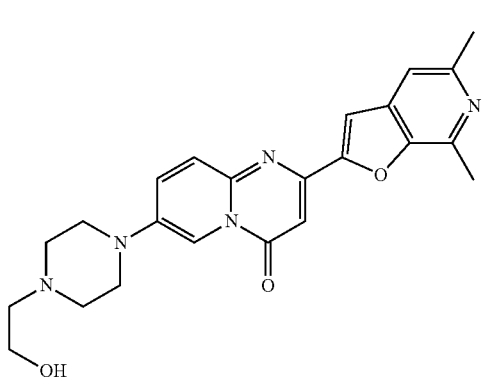
-continued
530
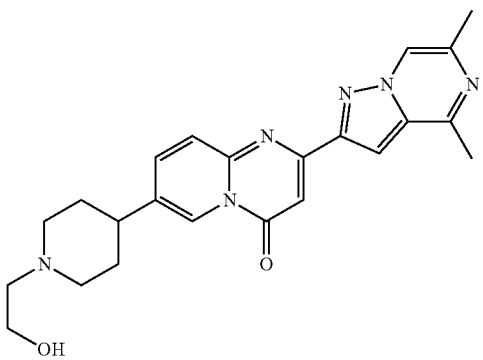
531
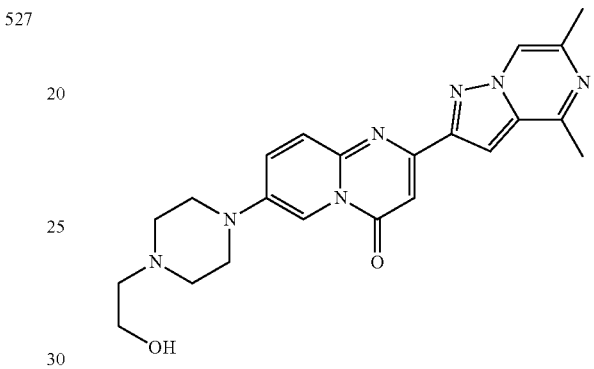
532
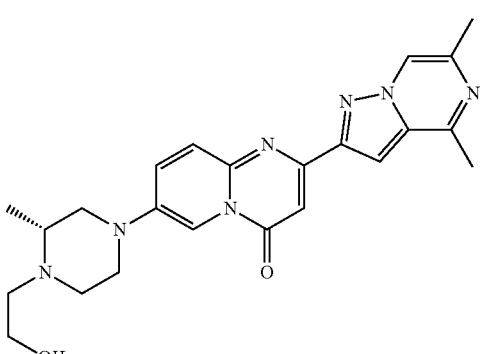
533
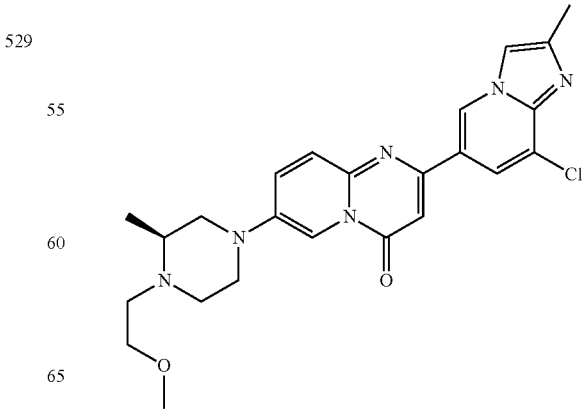

534
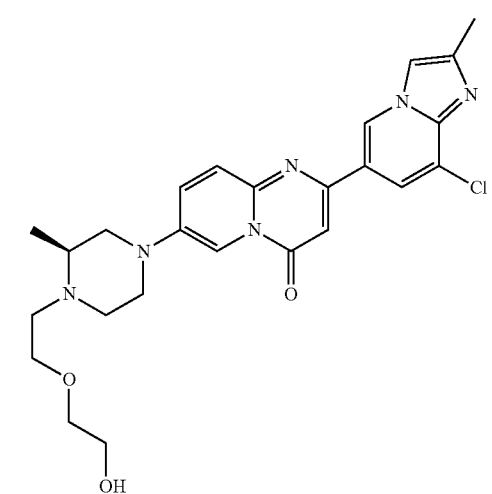
535
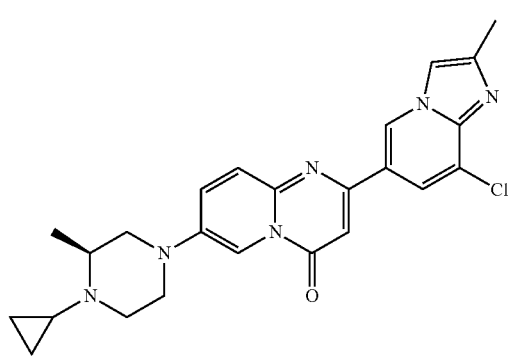
536
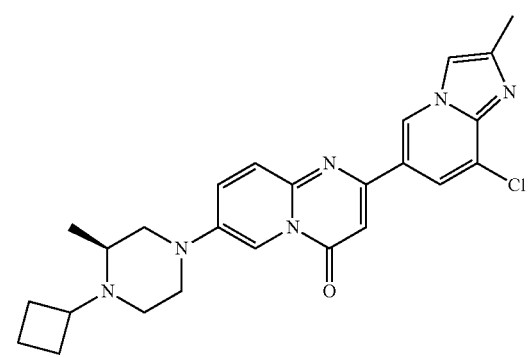
537
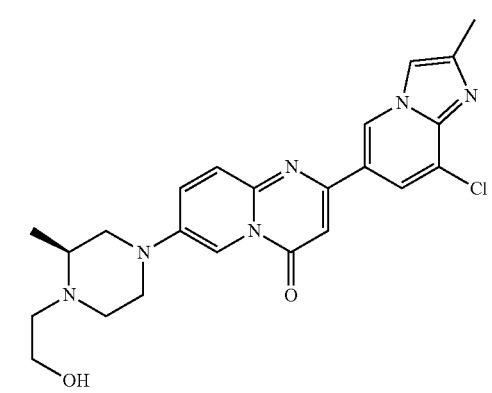
538
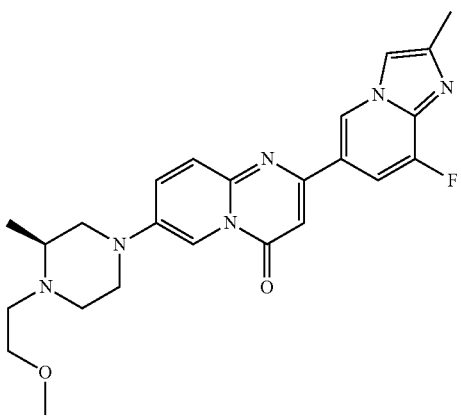
539
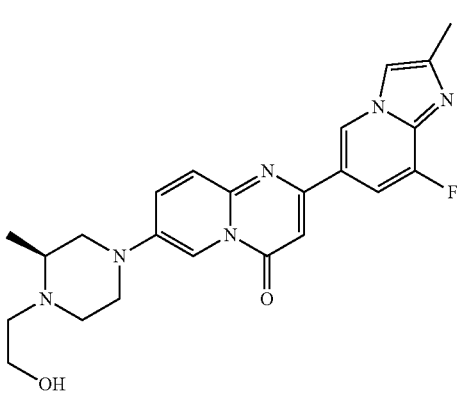
540
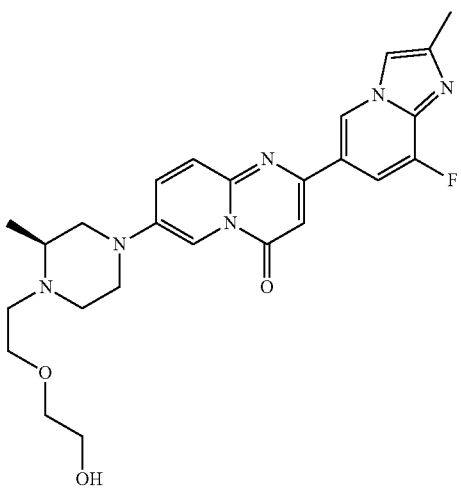
541
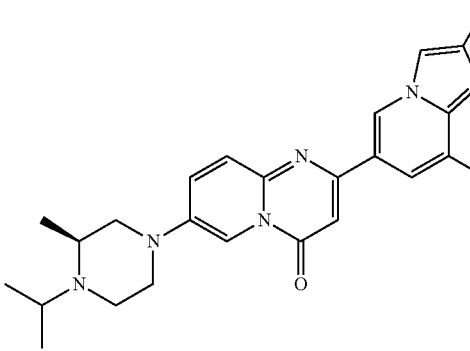

542
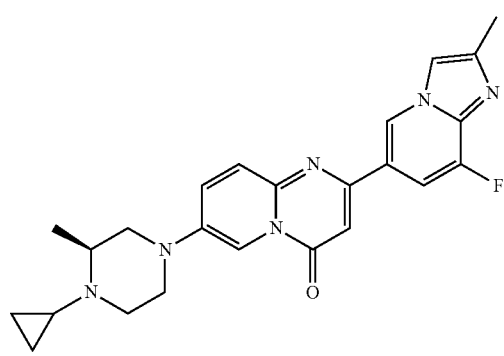
543
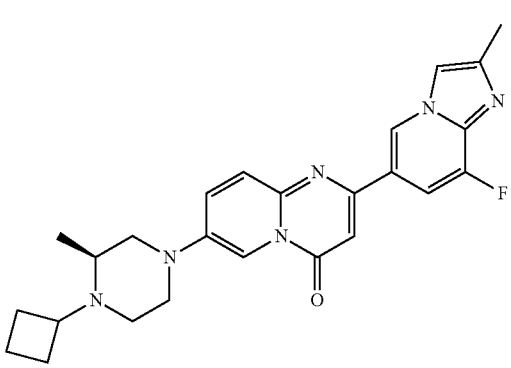
544
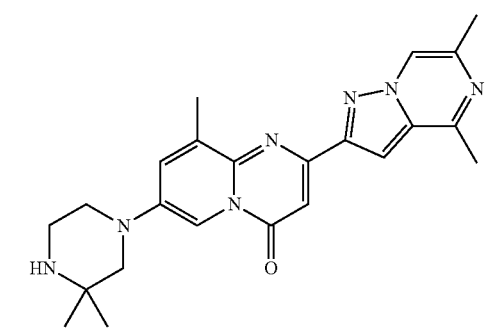
545
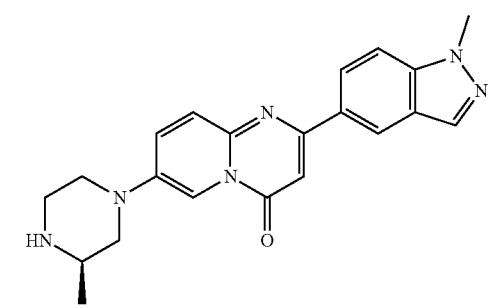
546
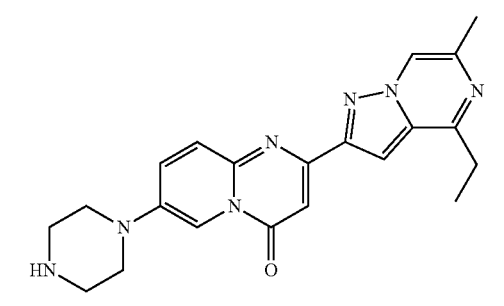
547
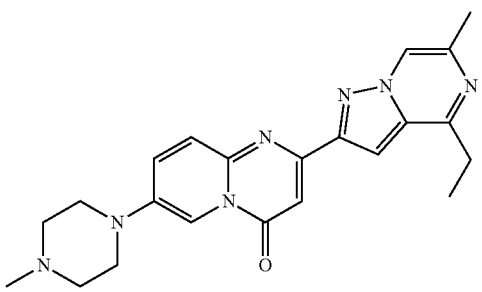
548
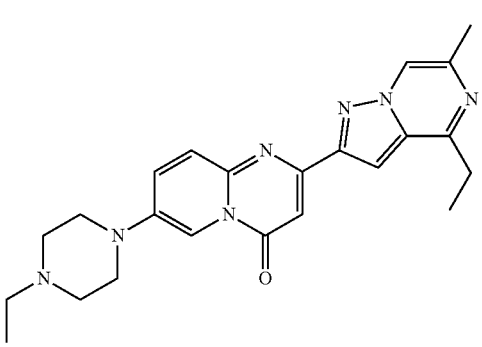
549
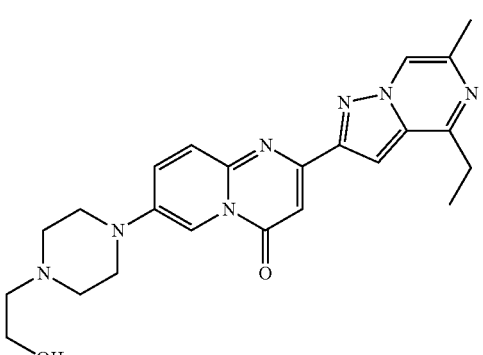
550
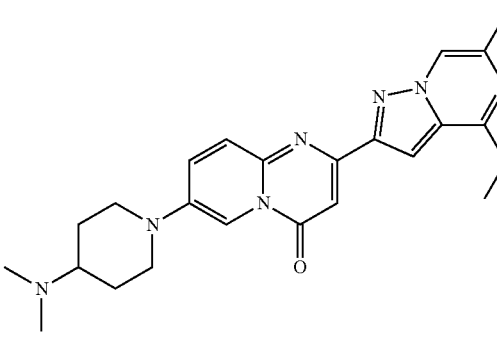

551 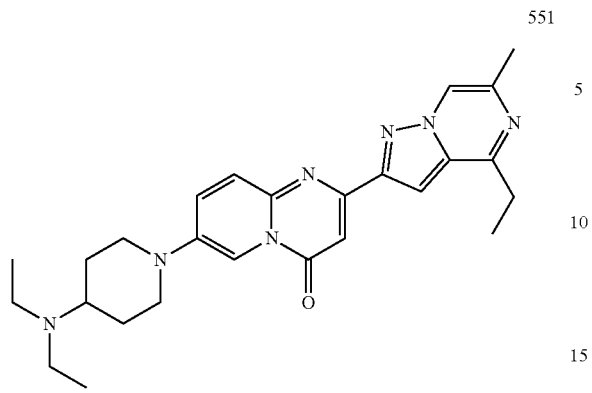
552 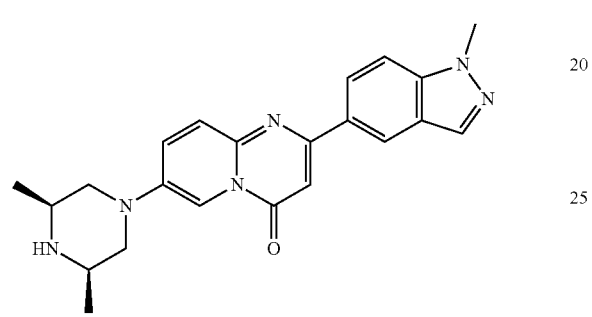
553 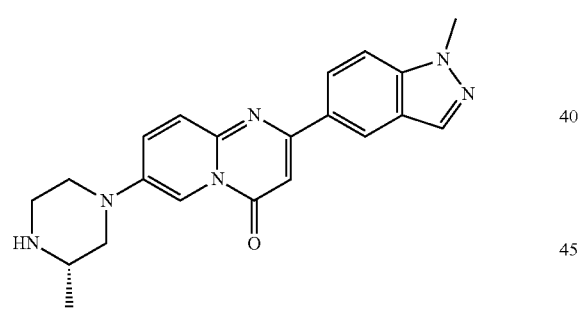
554 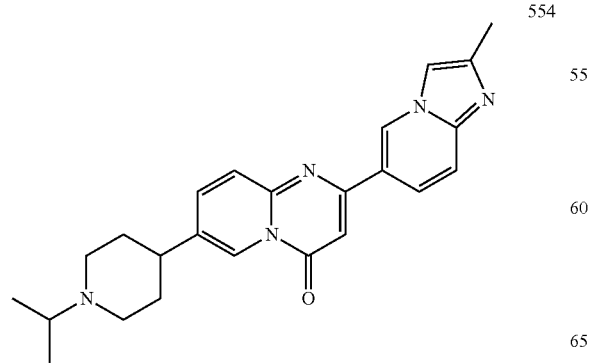
555 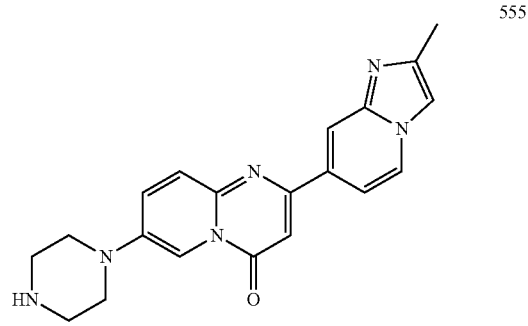
556 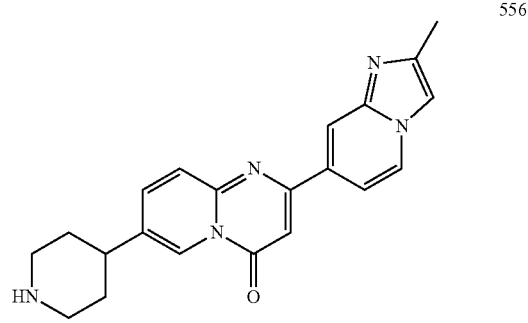
557 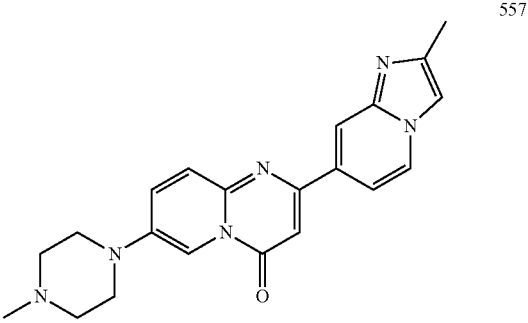
558 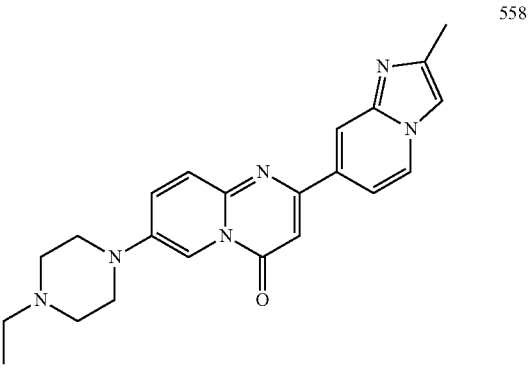
559 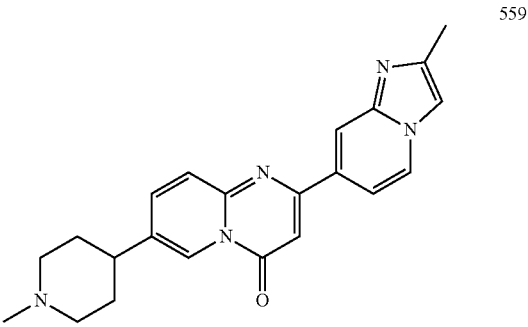

-continued
560
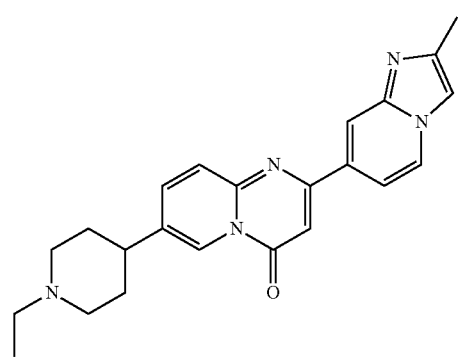
561
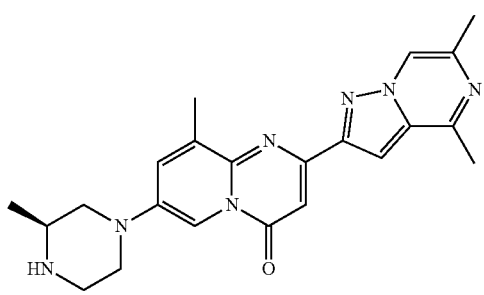
562
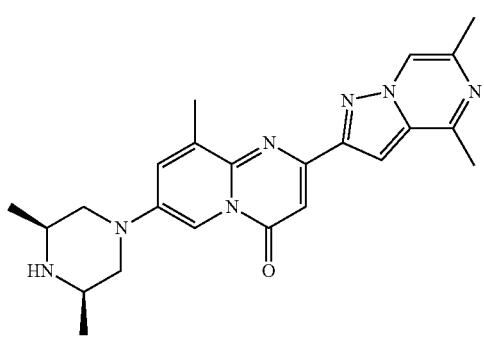
563
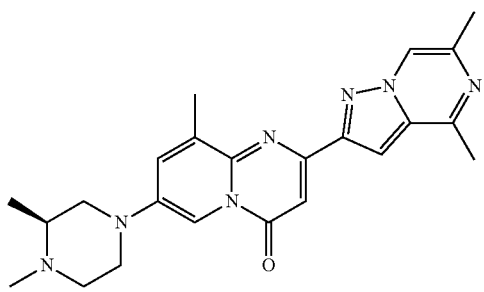
564
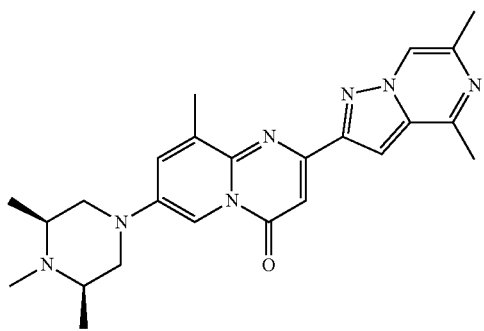
-continued
565
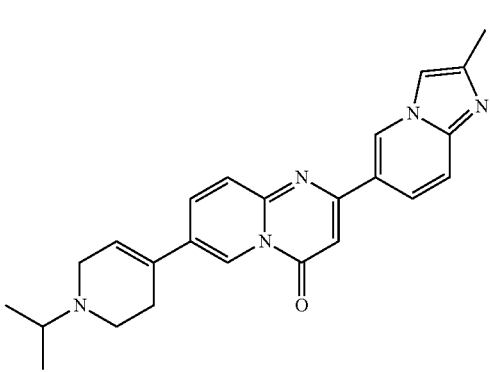
566
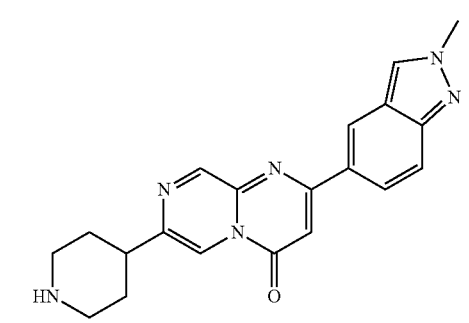
567
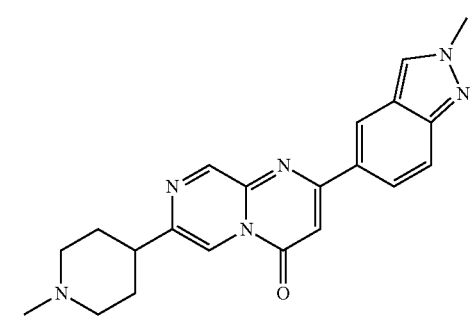
568
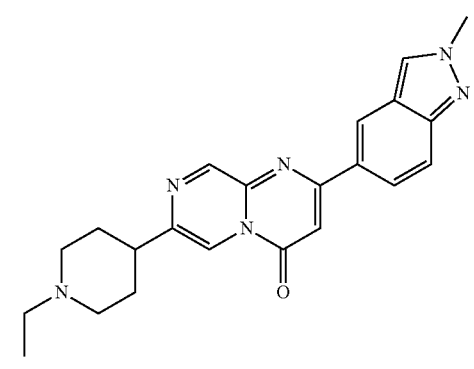

353
-continued
569
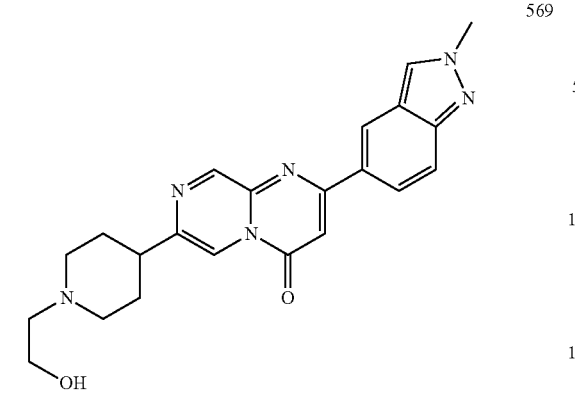
570
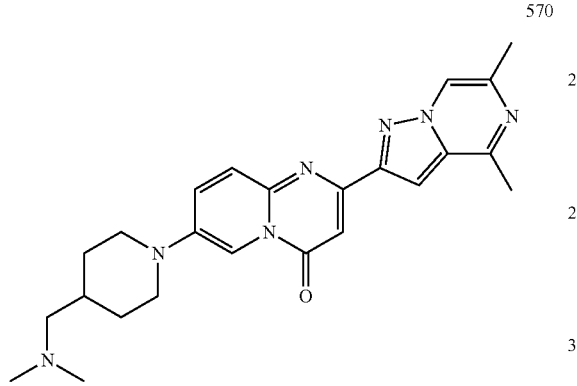
571
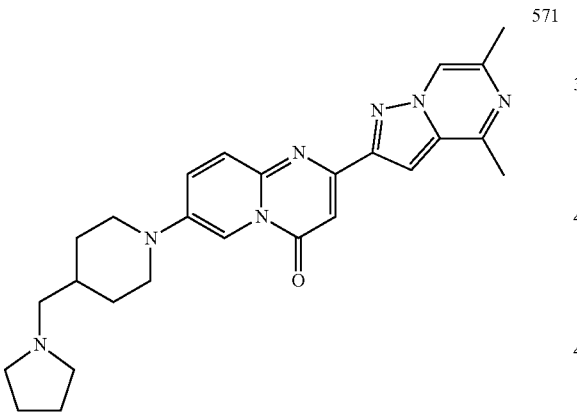
572
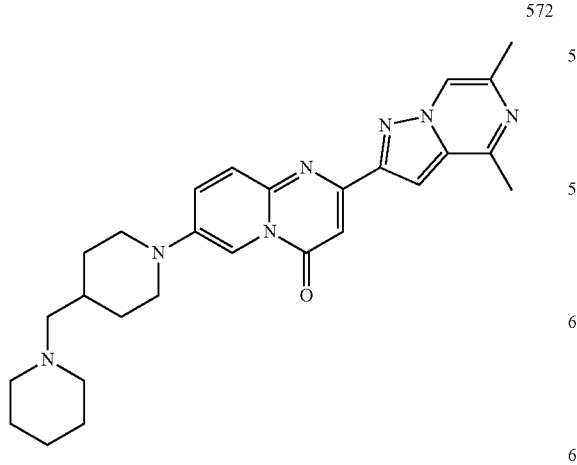
354
-continued
573
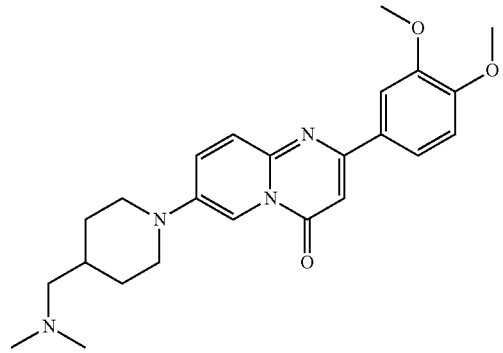
574
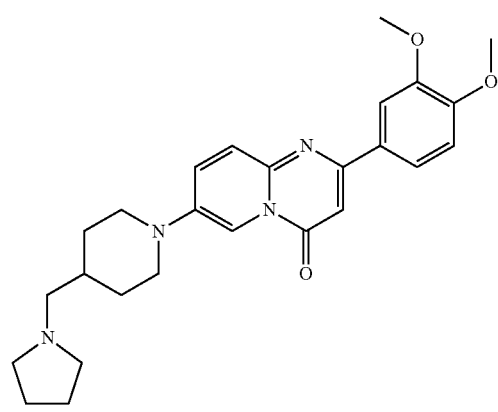
575
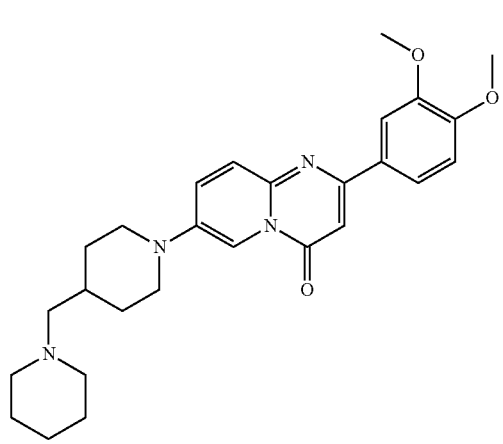
576
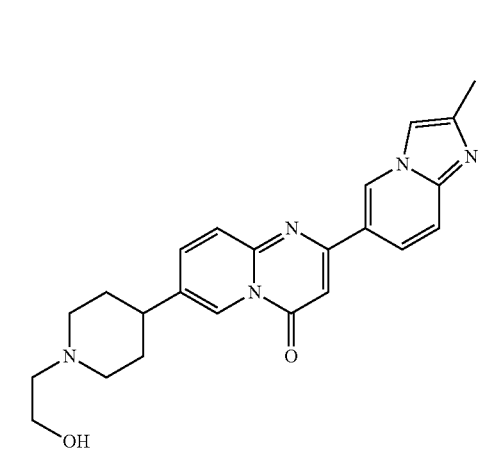

577 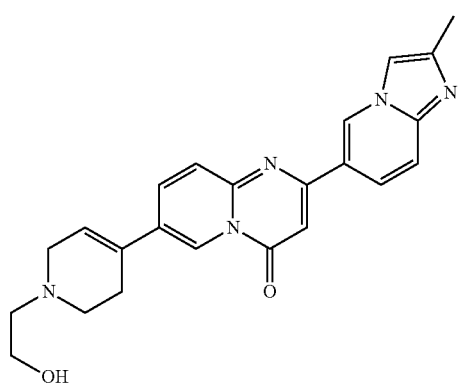
578 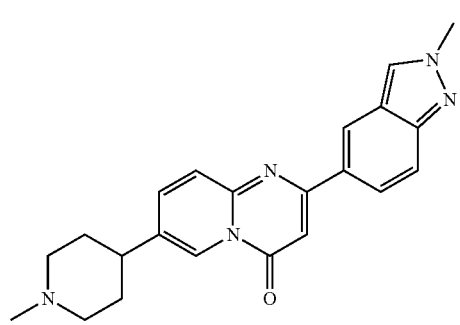
579 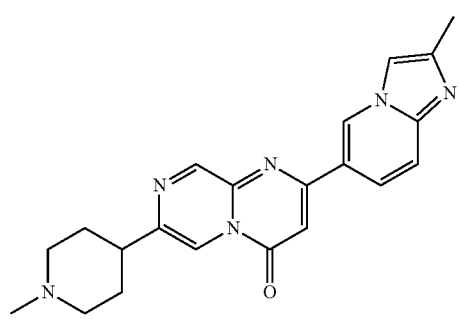
580 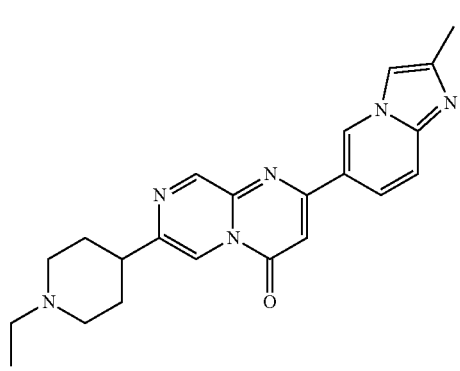
581 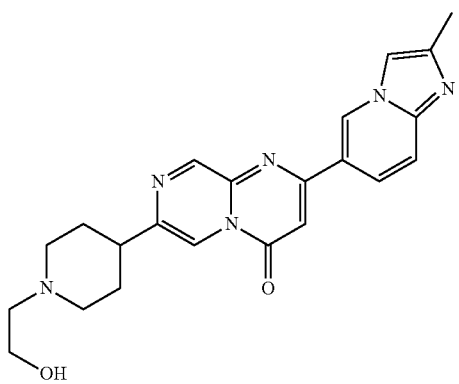
582 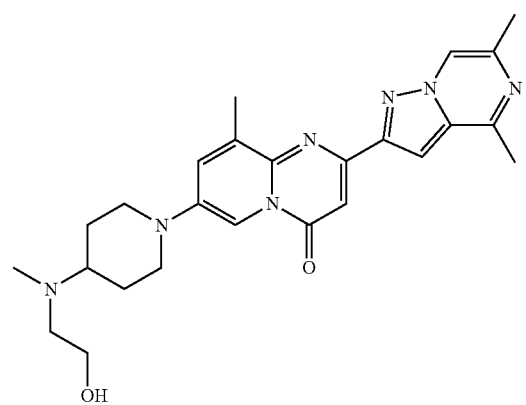
583 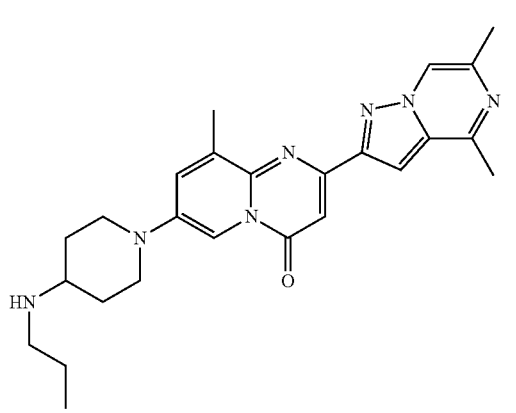
584 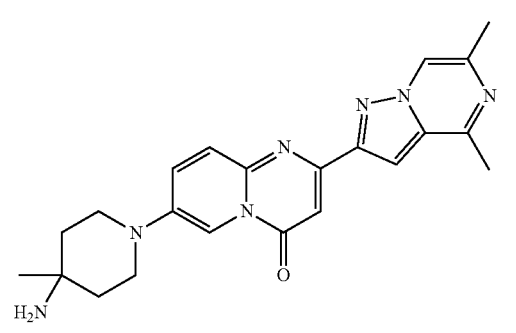

585 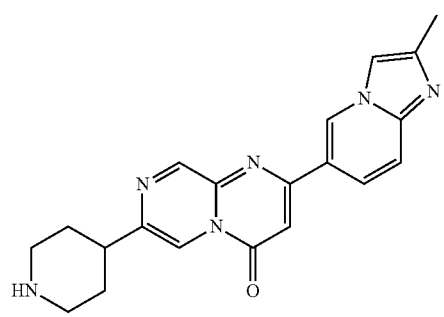
586 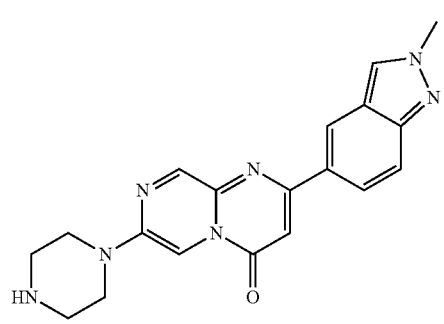
587 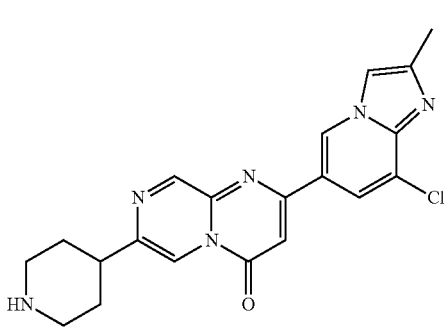
588 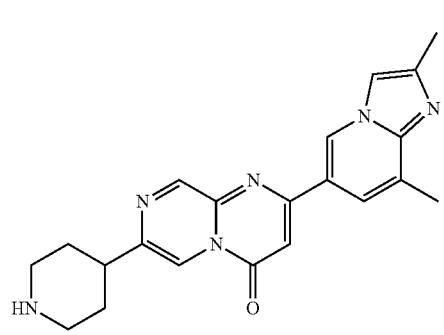
589 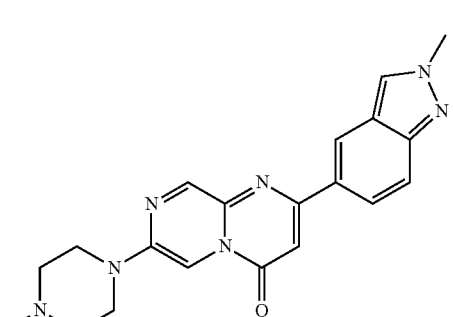
590 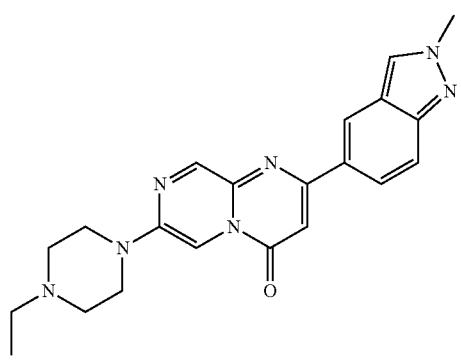
591 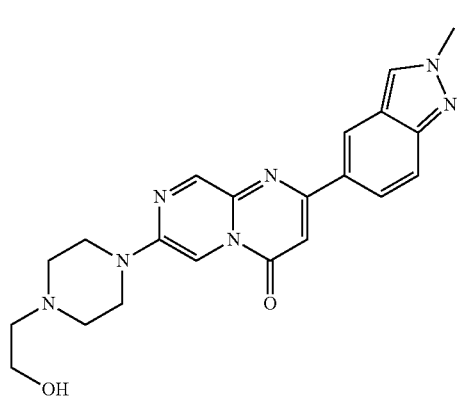
592 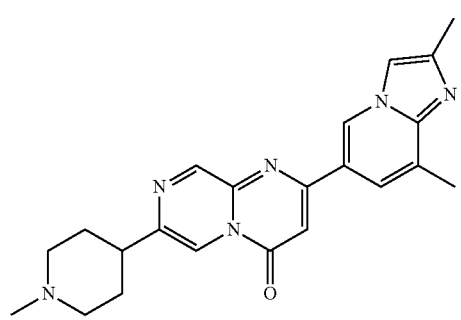
593 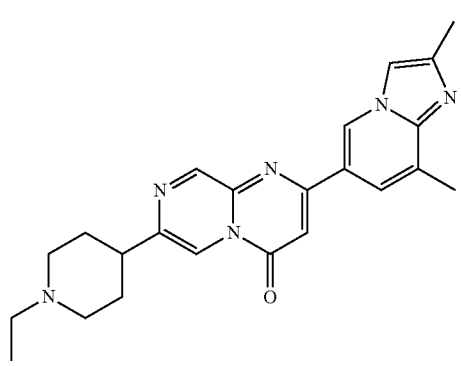

| 359 -continued | 360 -continued |
|---|---|
| 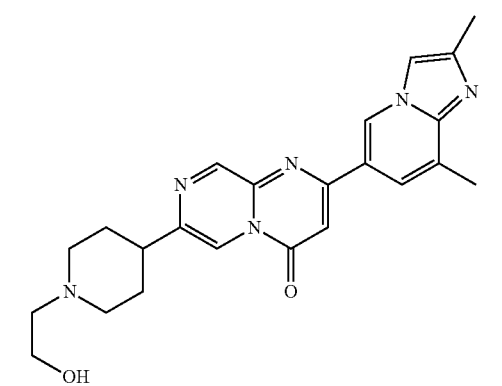 594 | 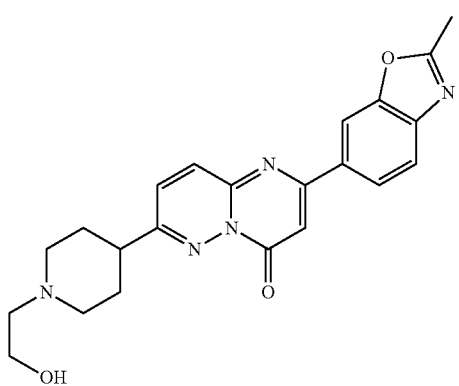 598 |
| 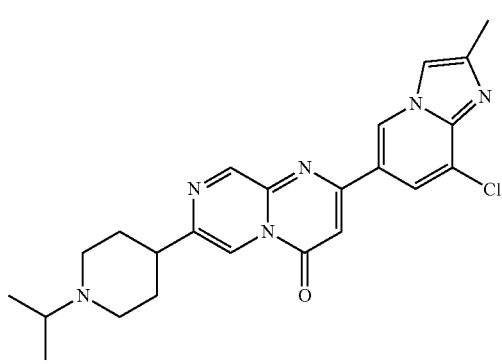 595 | 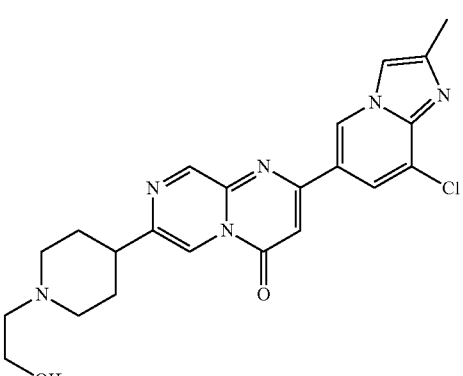 599 |
| 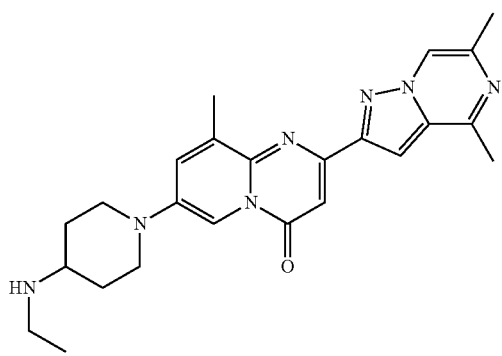 596 | 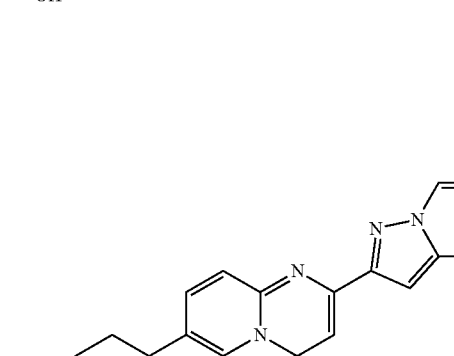 600 |
| 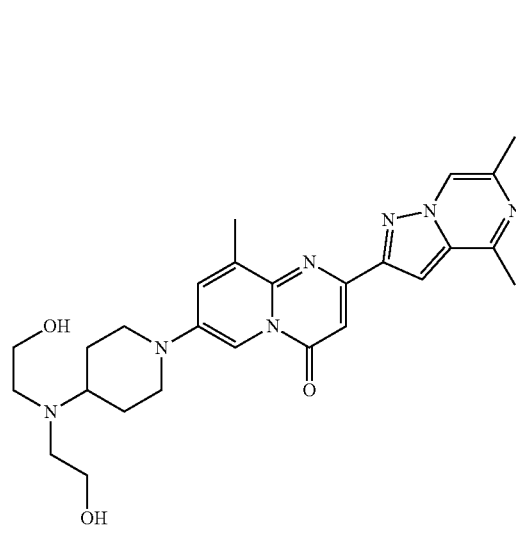 597 | 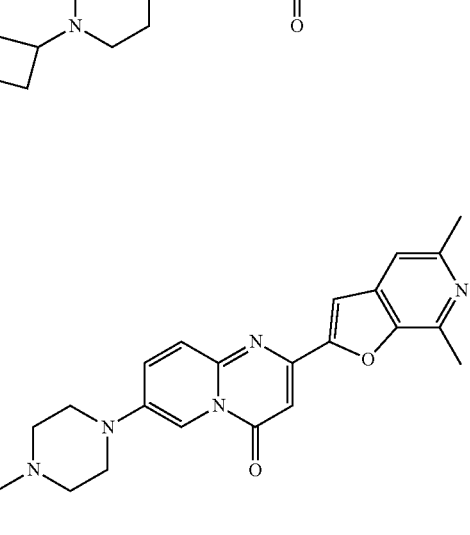 601 |

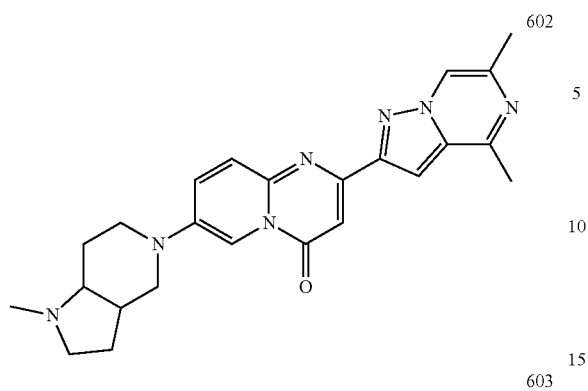
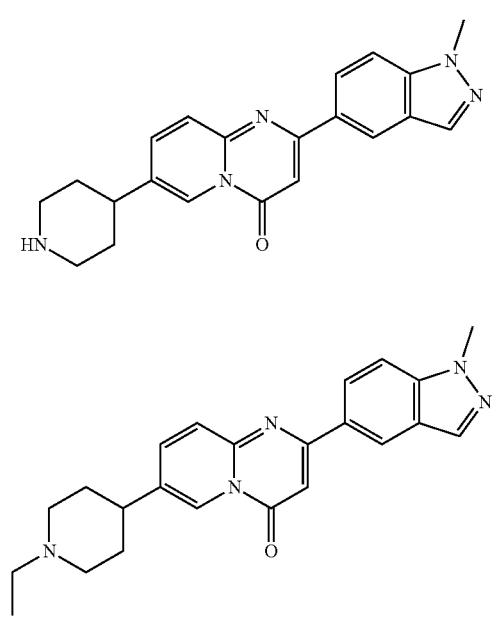
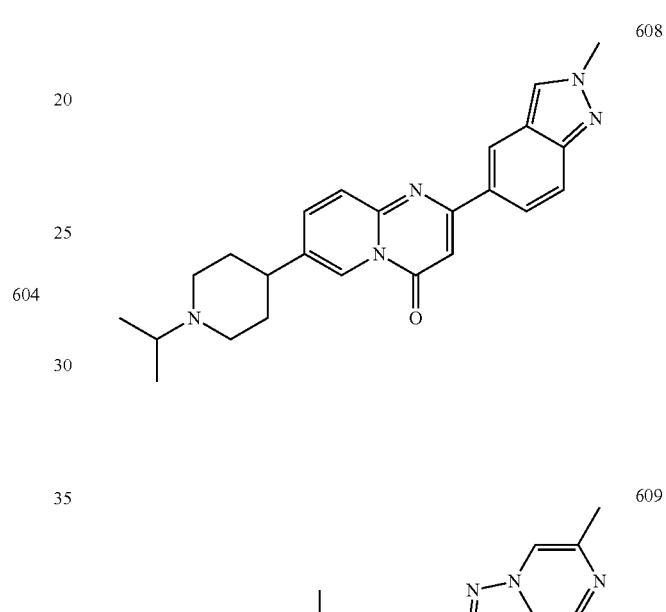
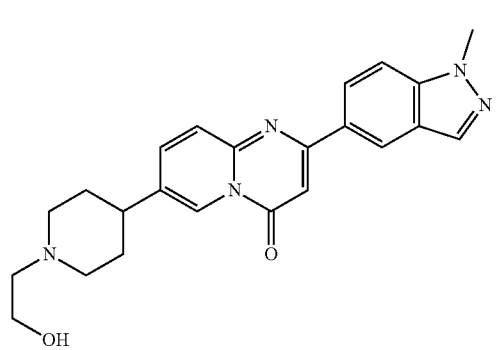
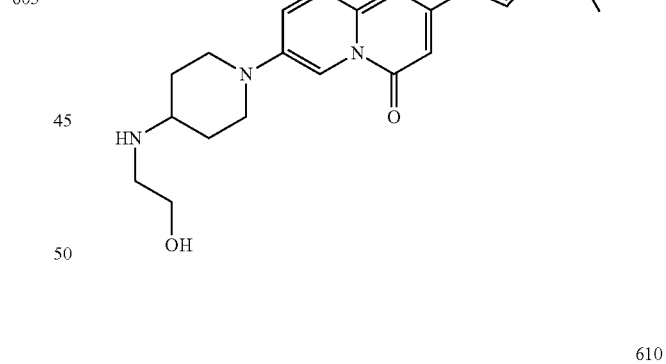
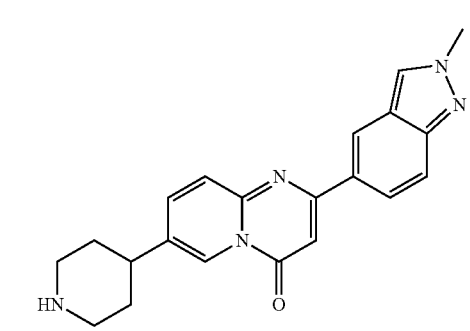
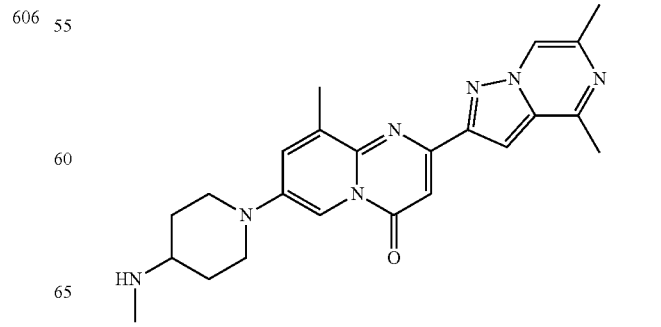

363
-continued
611
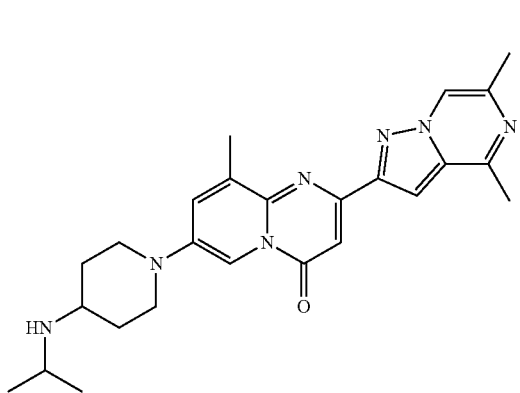
612
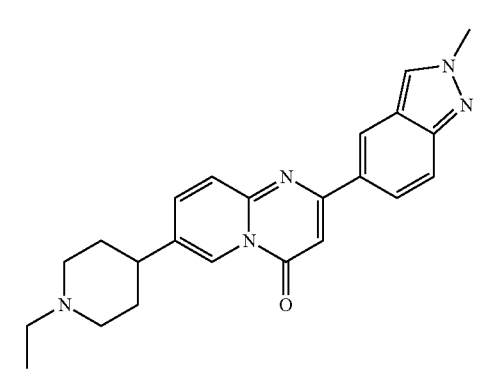
613
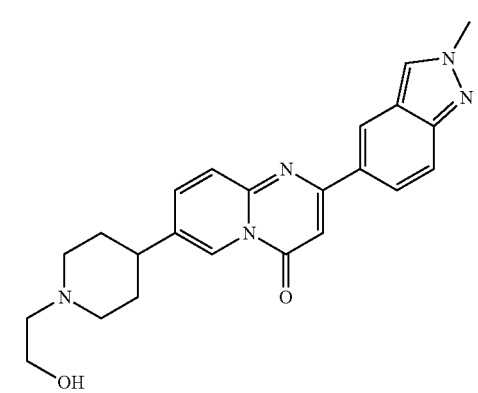
614
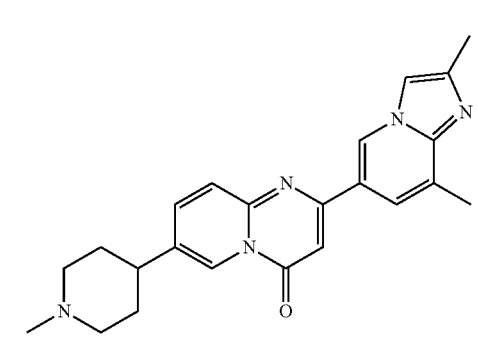
364
-continued
615
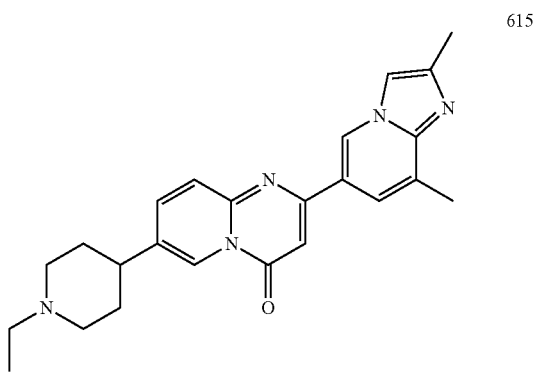
616
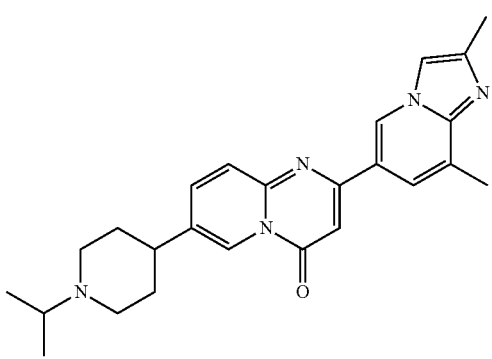
617
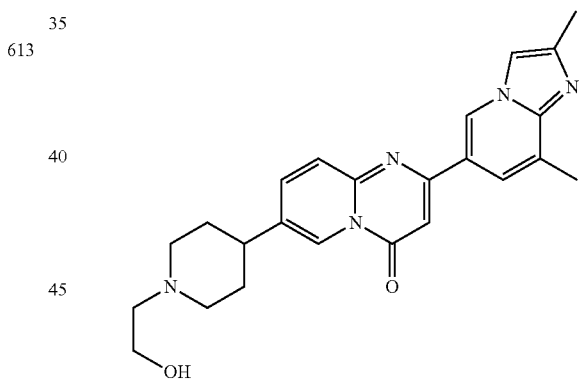
618
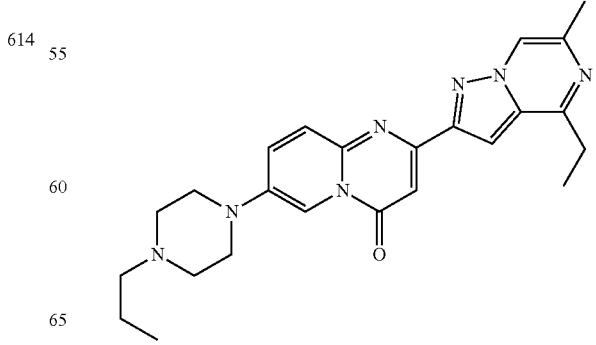

365
-continued
619
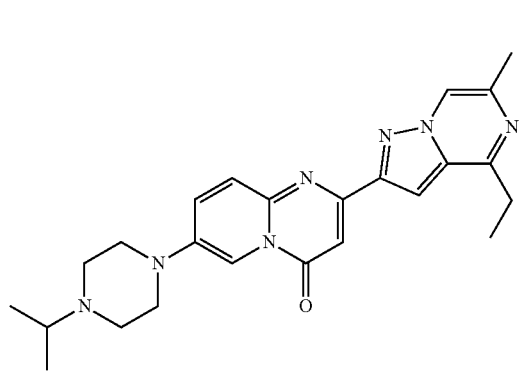
620
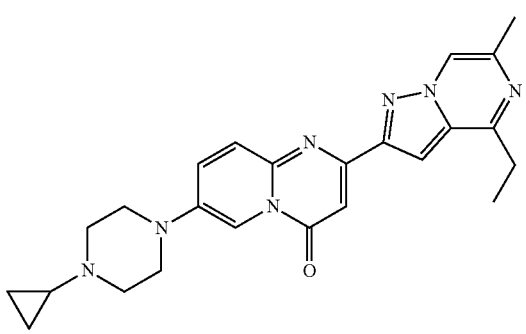
621
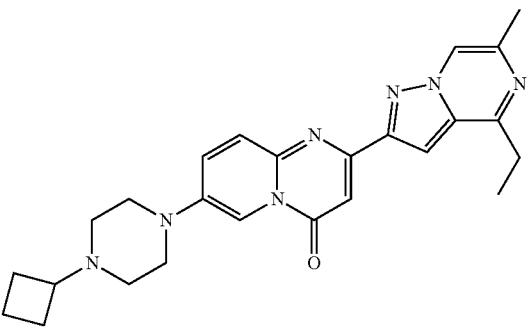
622
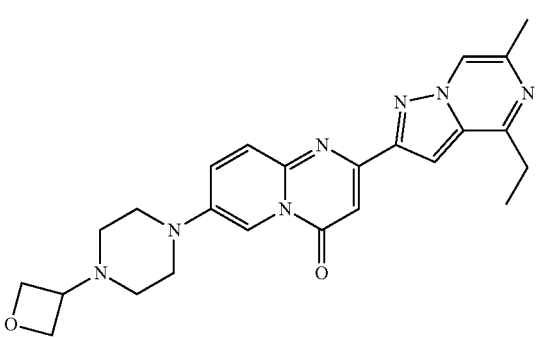
366
-continued
623
624
625
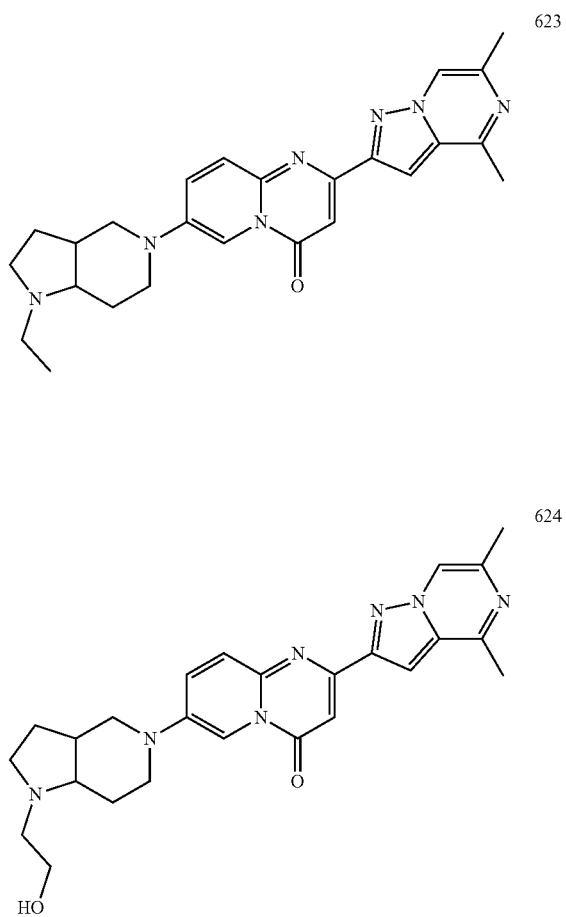
626
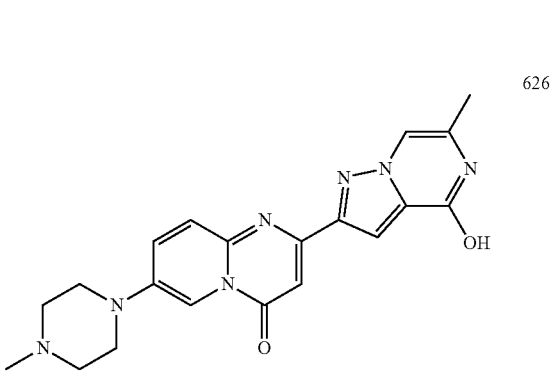

627
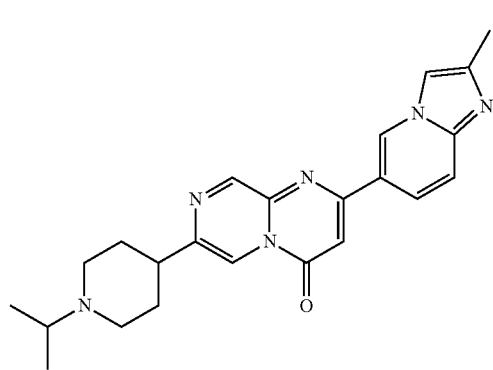
628
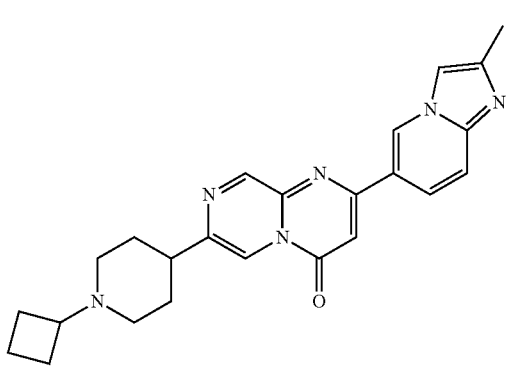
629
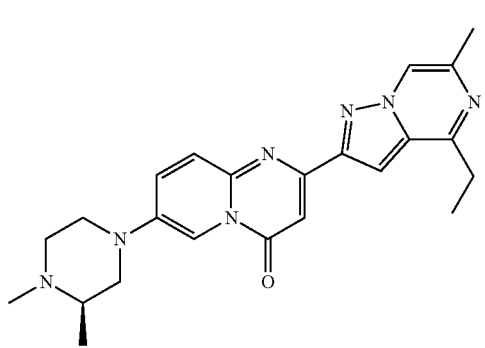
630
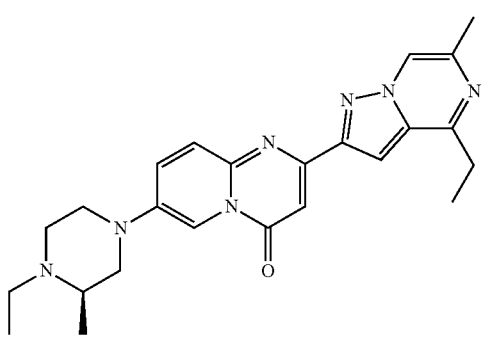
631
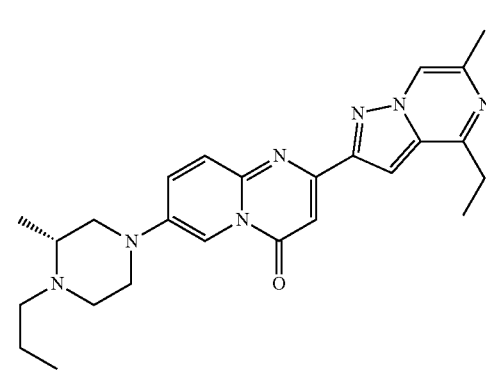
632
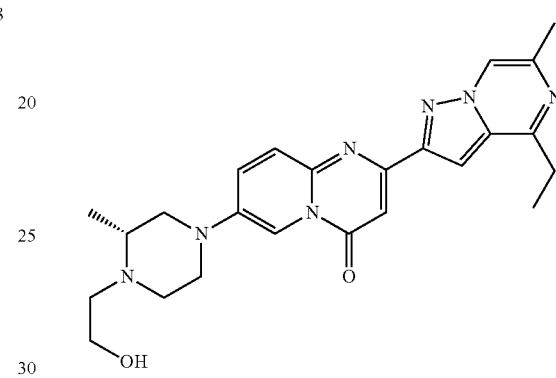
633
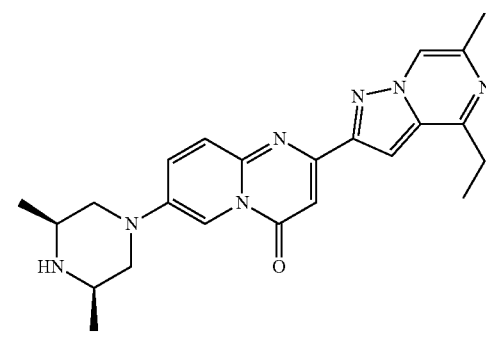
634
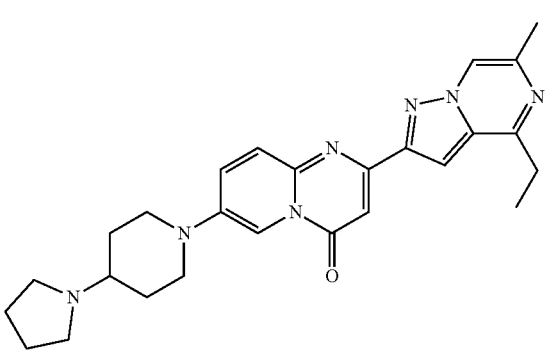

635 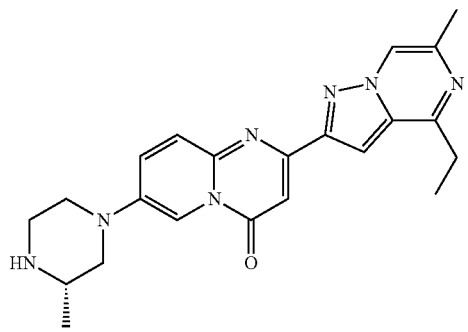
640 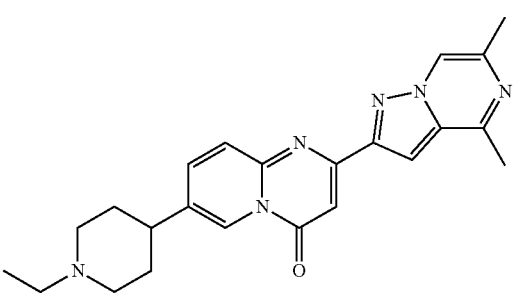
636 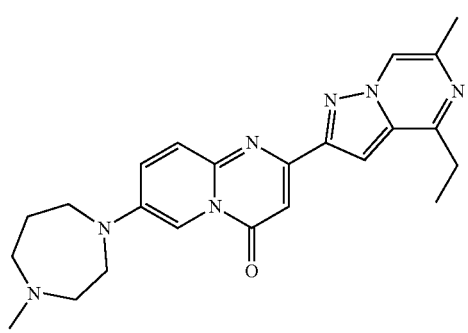
641 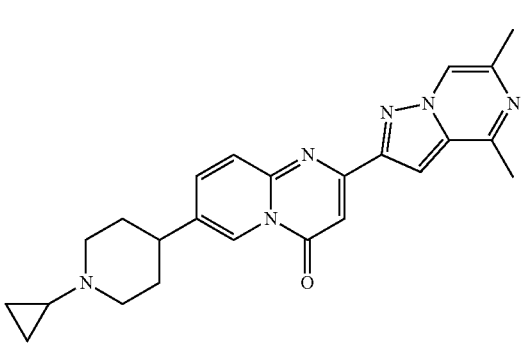
637 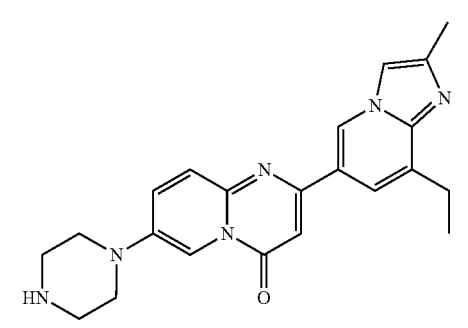
642 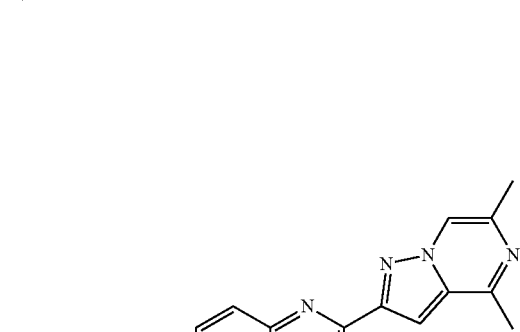
638 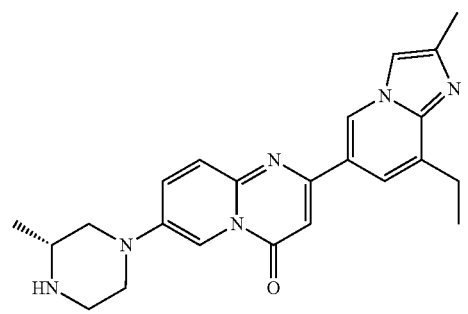
643 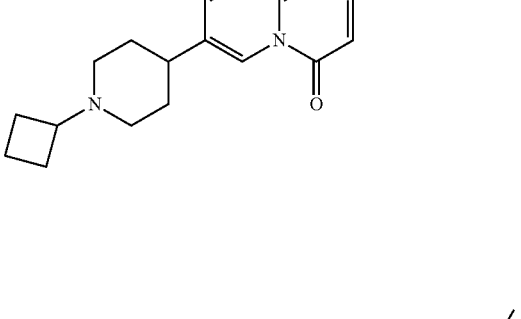
639 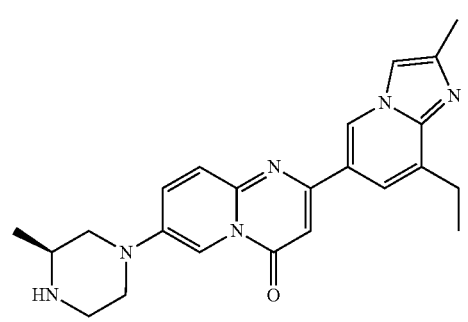
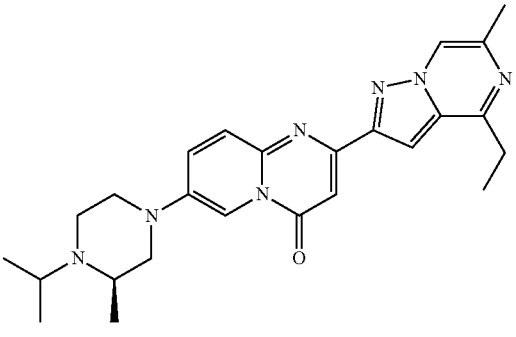

644
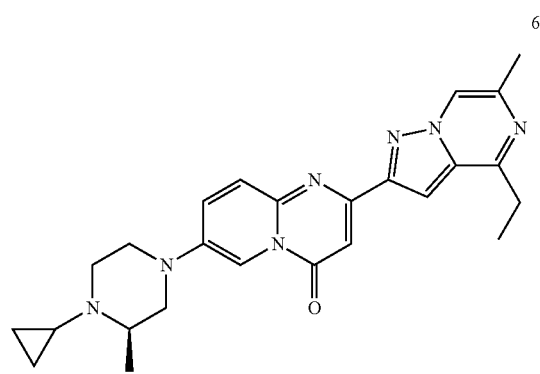
645
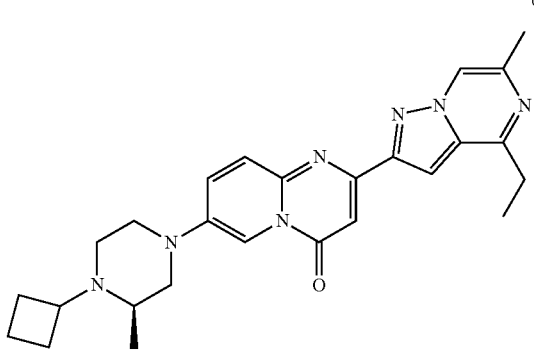
646
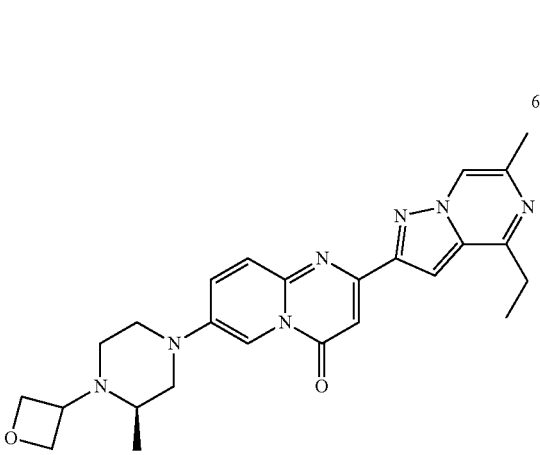
647
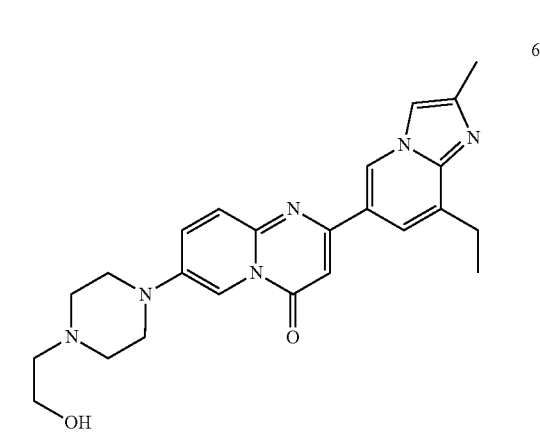
648
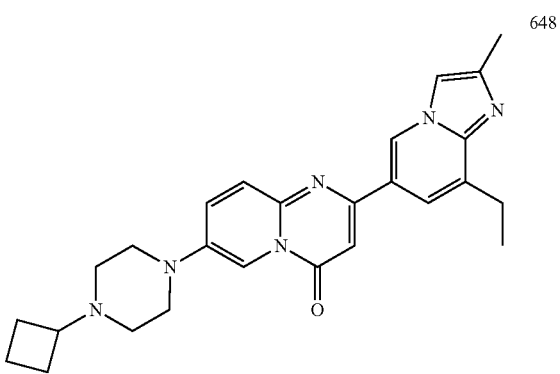
649
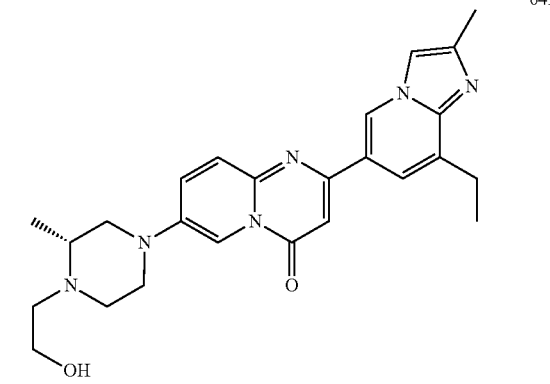
650
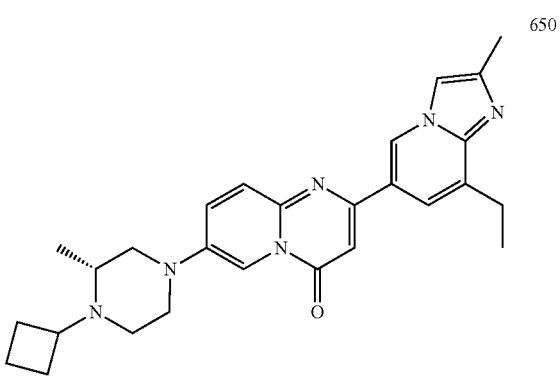
651
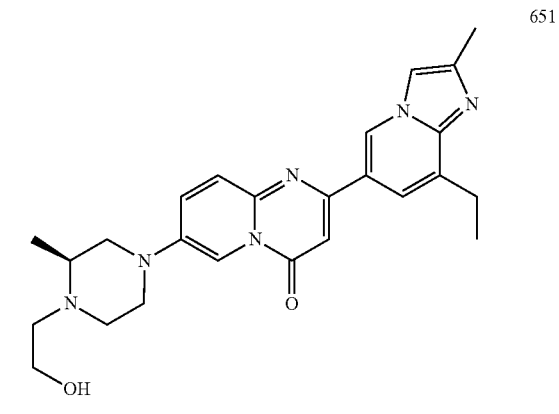

373
-continued
652
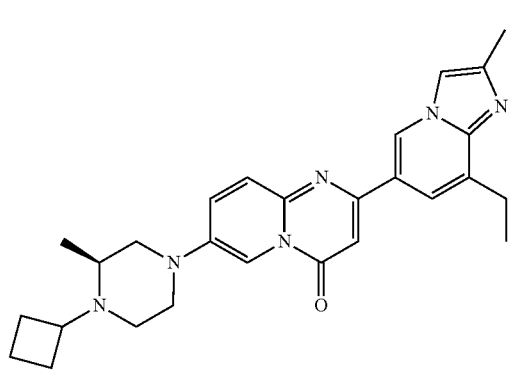
653
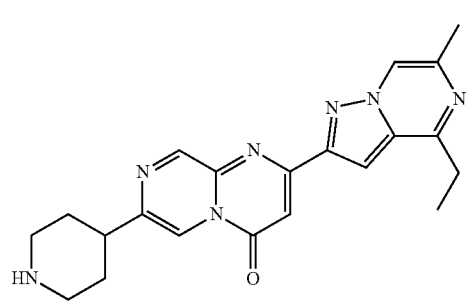
654
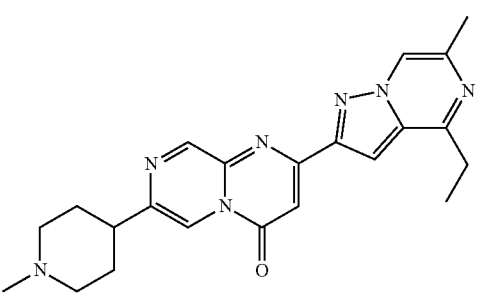
655
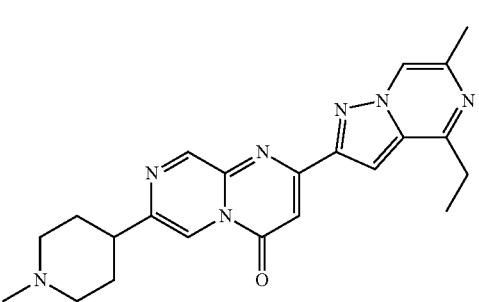
656
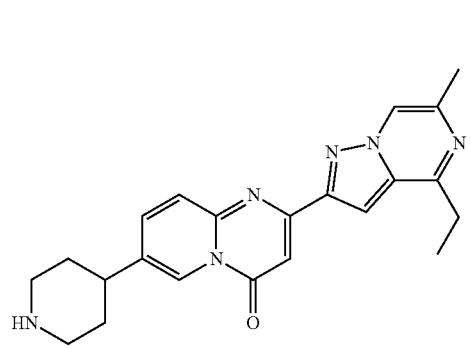
374
-continued
657
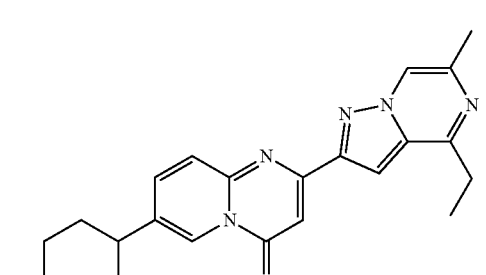
658
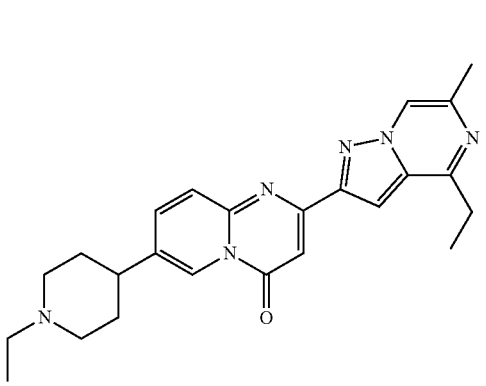
659
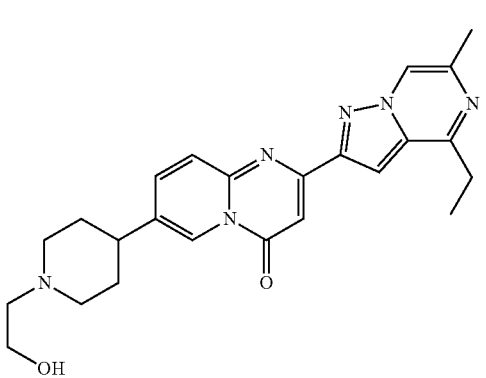
660
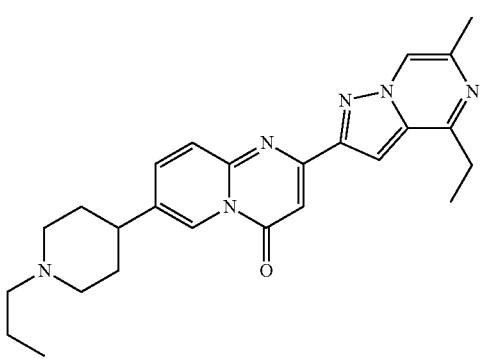

661
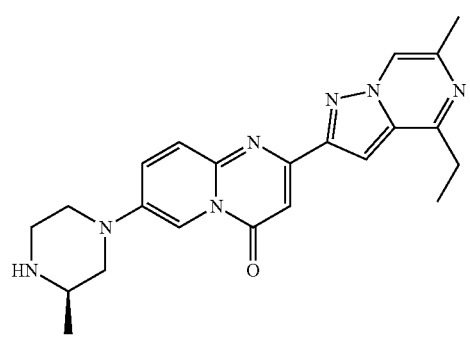
662
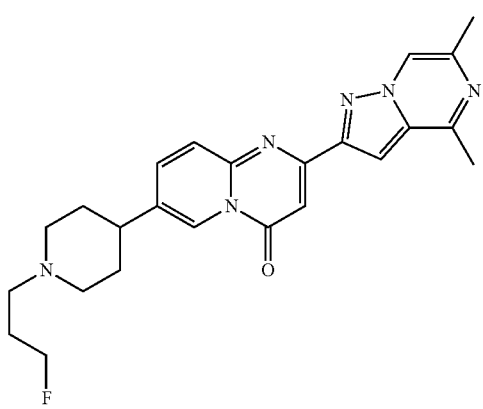
663
664
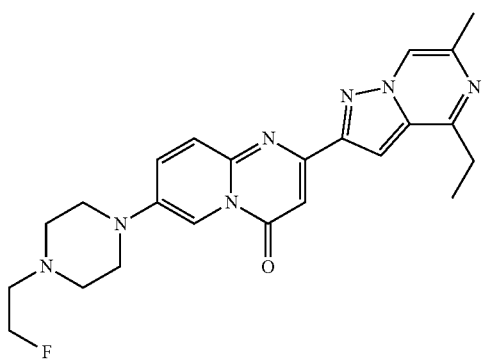
665
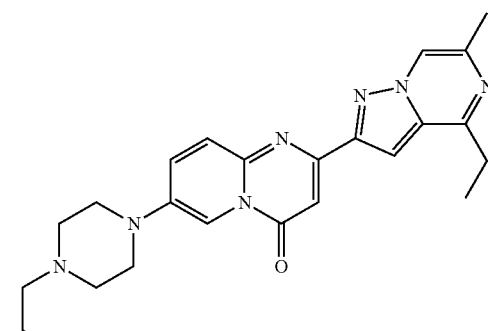
666
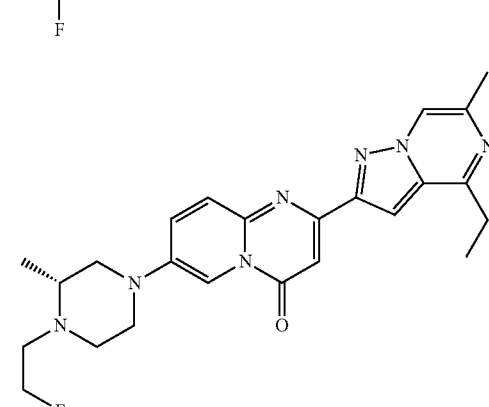
667
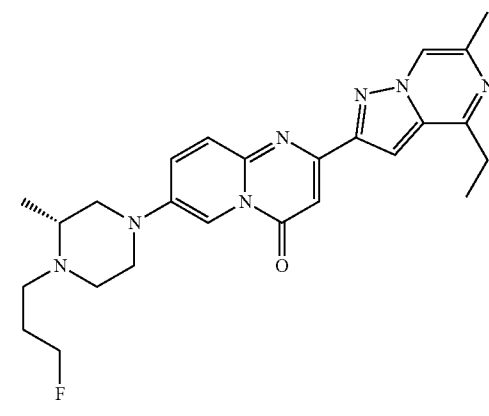
668
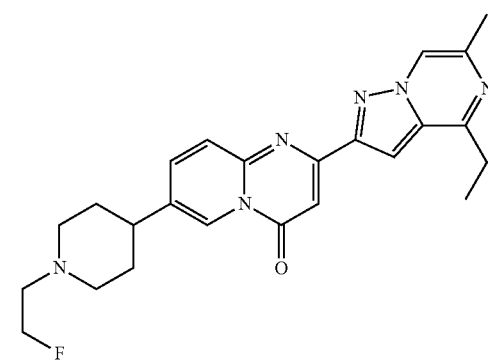

669
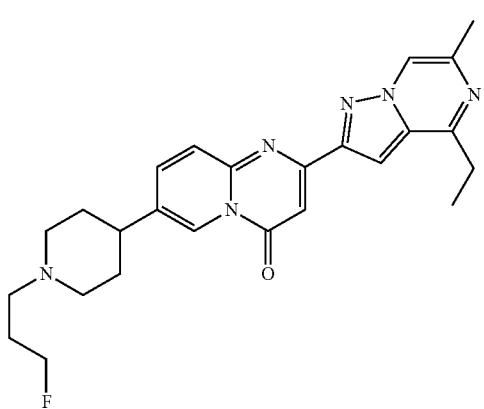
670
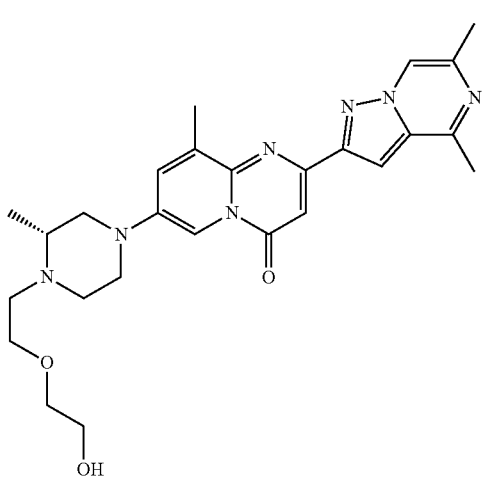
671
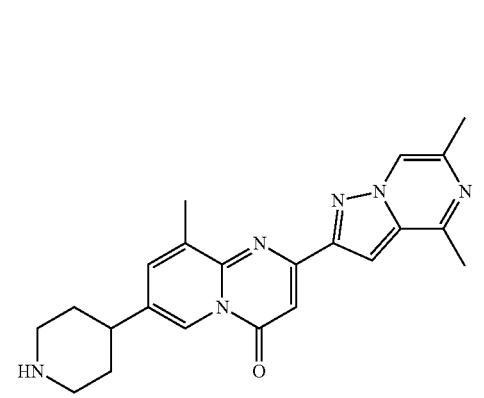
672
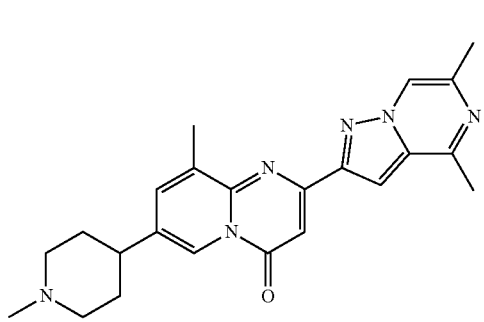
673
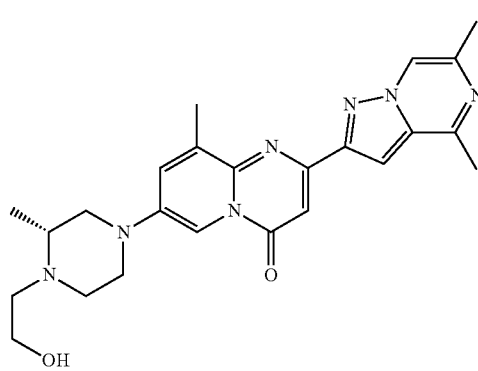
674
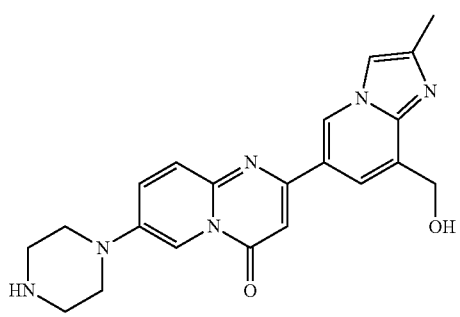
675
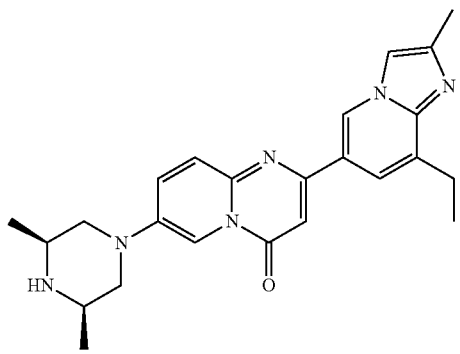
676
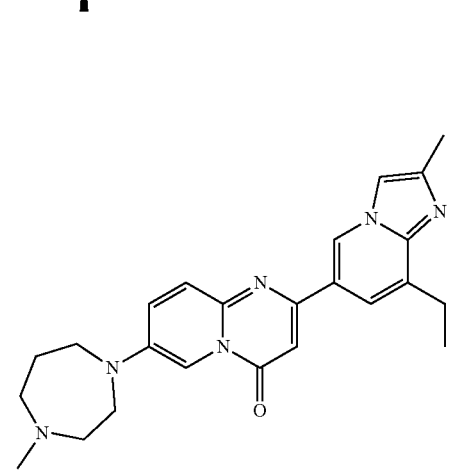

379 -continued
677
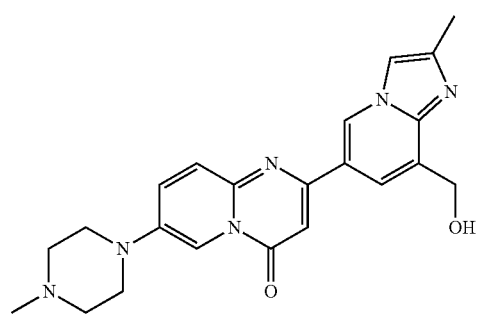
678
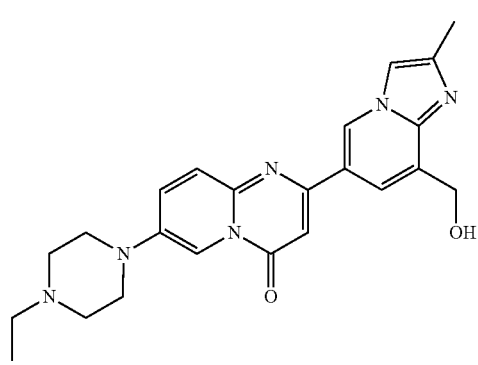
679
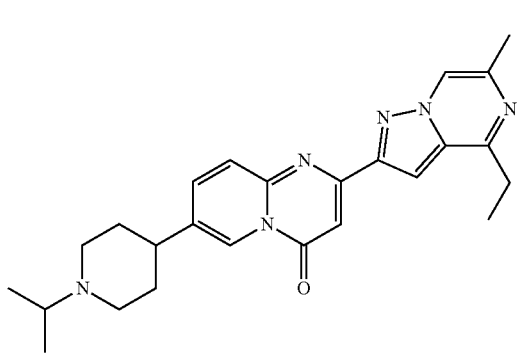
680
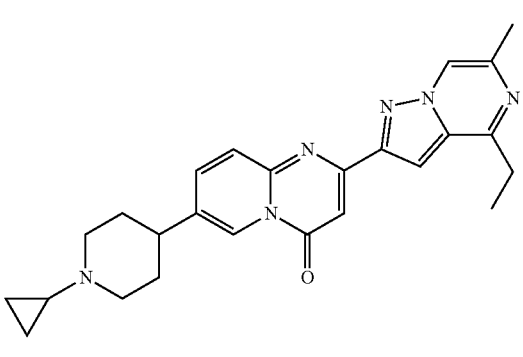
380 -continued
681
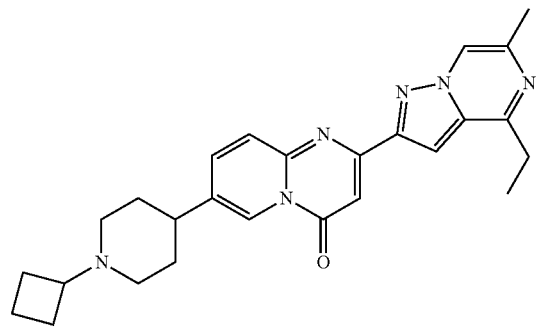
682
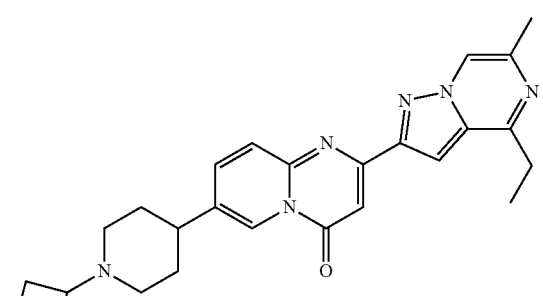
683
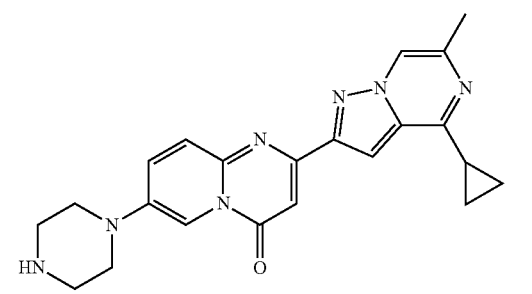
684
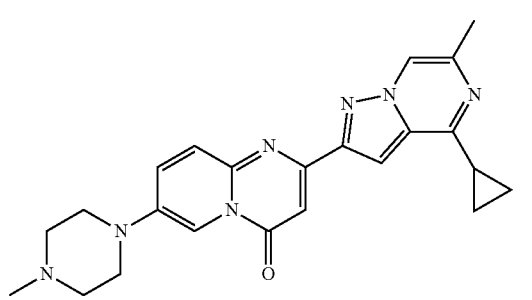
685
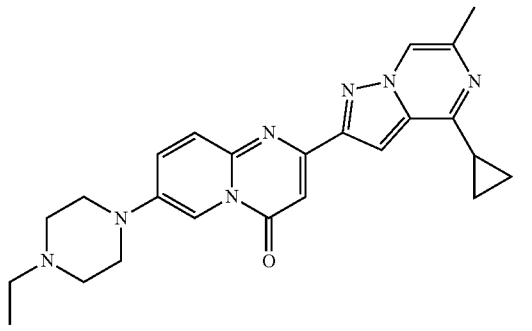

-continued
686
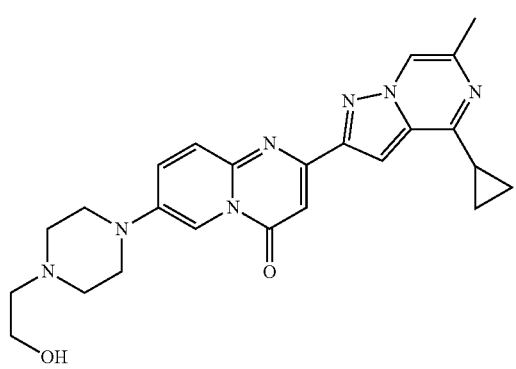
687
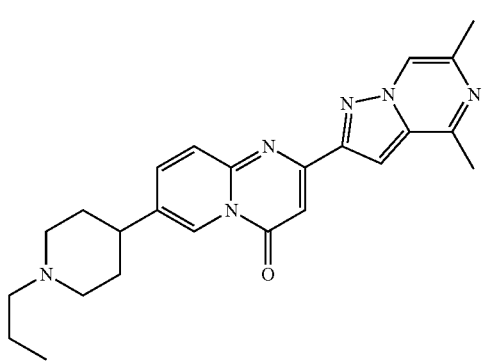
688
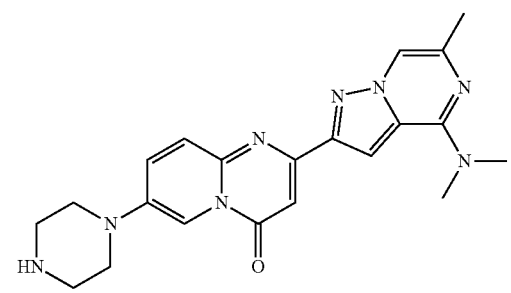
689
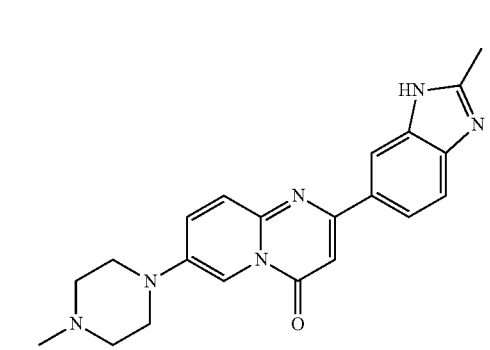
-continued
690
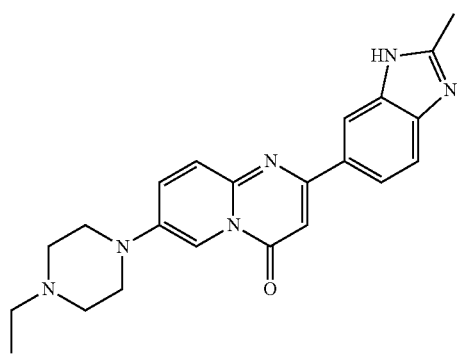
691
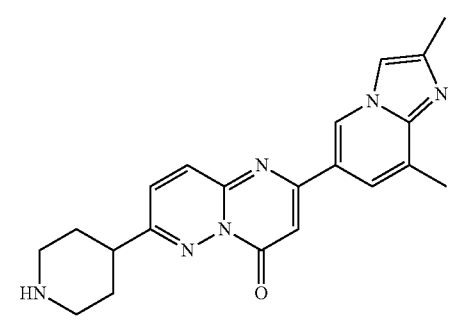
692
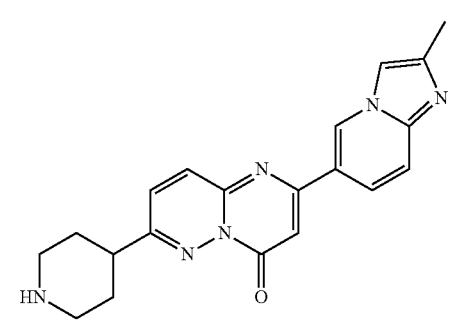
693
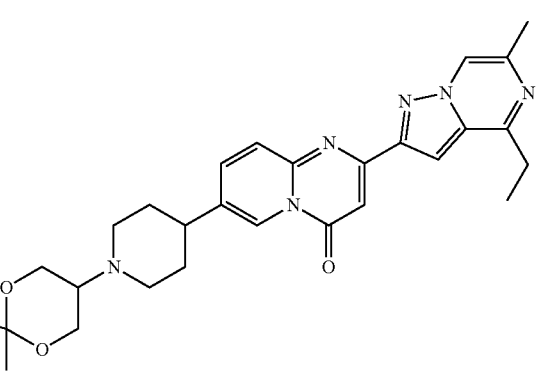

-continued
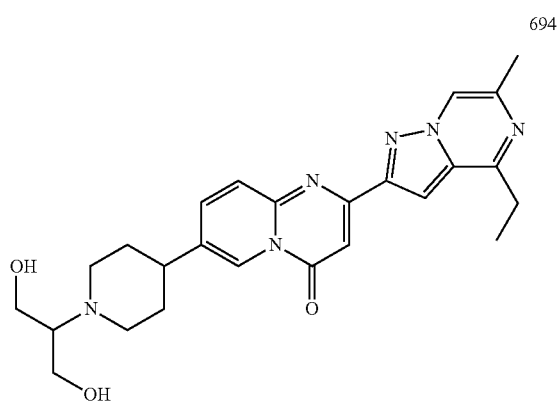
694
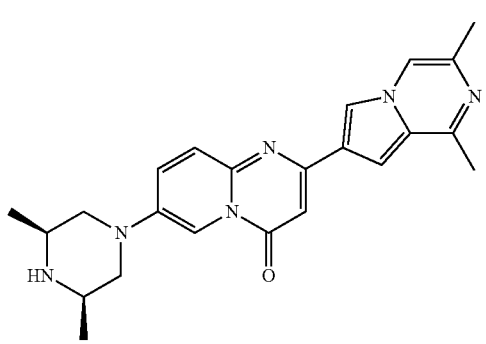
695
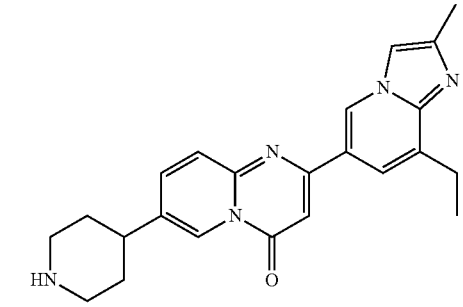
696
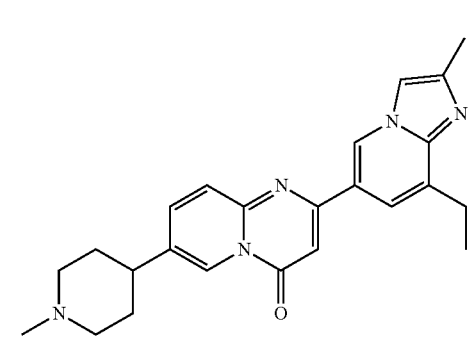
697
-continued
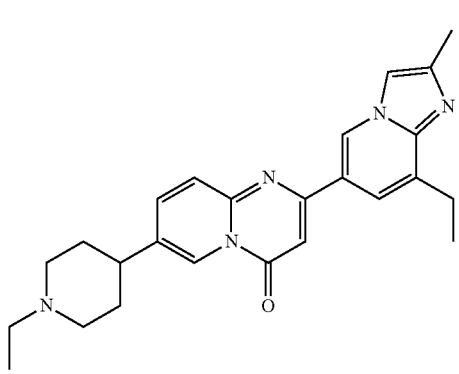
698
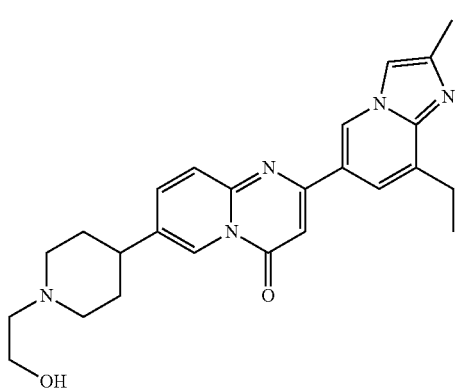
699
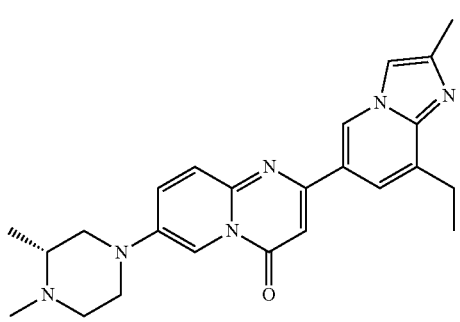
700
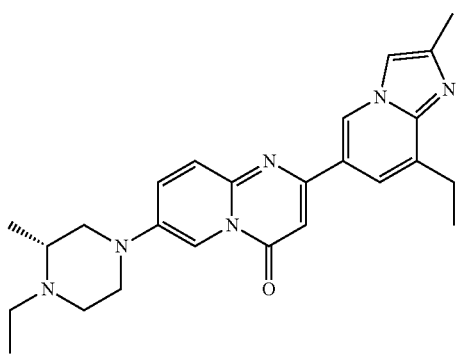
701

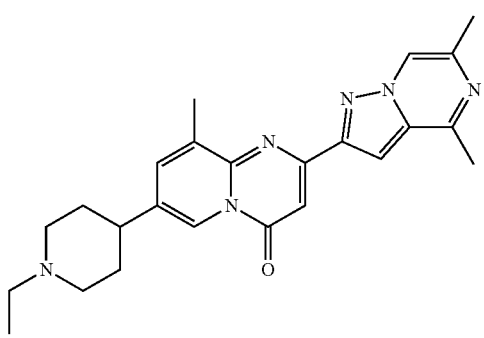
702
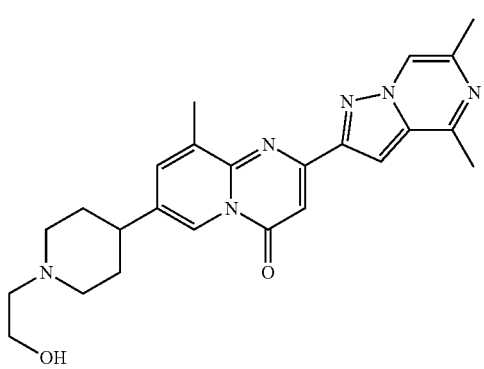
703
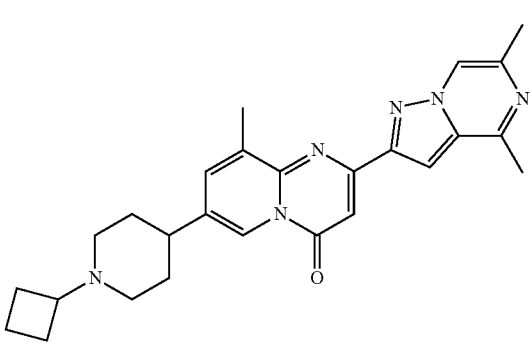
704
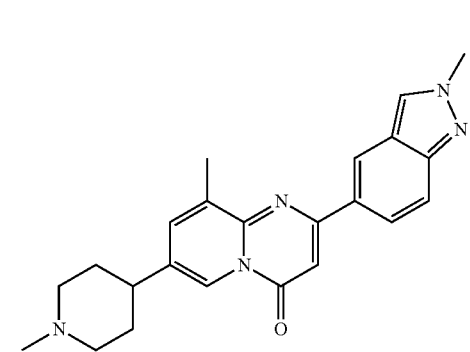
705
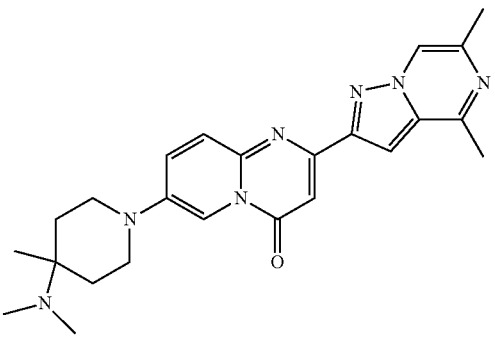
706
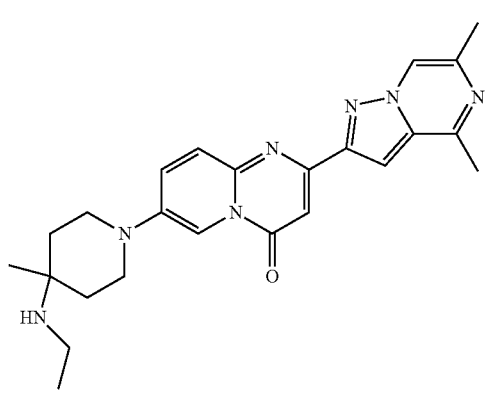
707
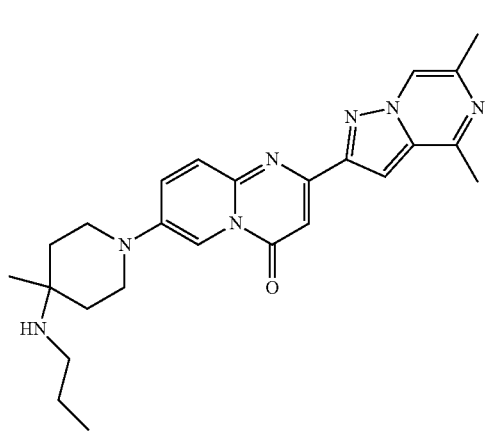
708
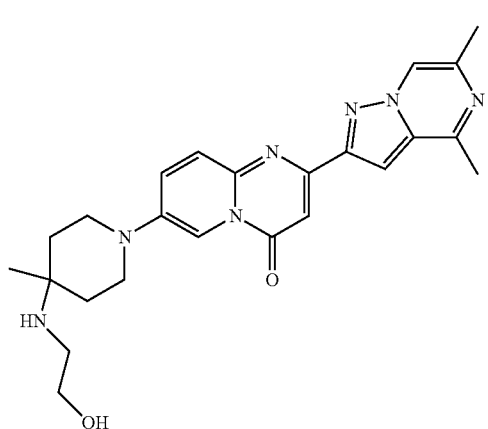
709

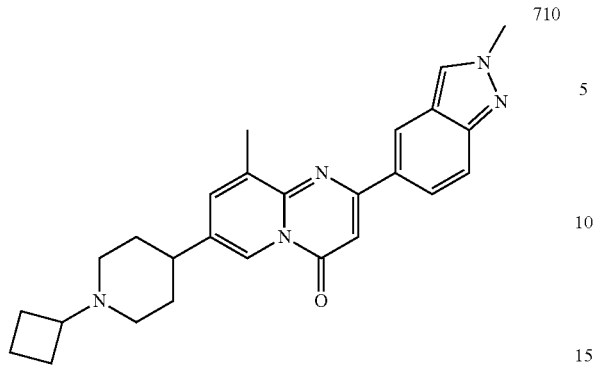
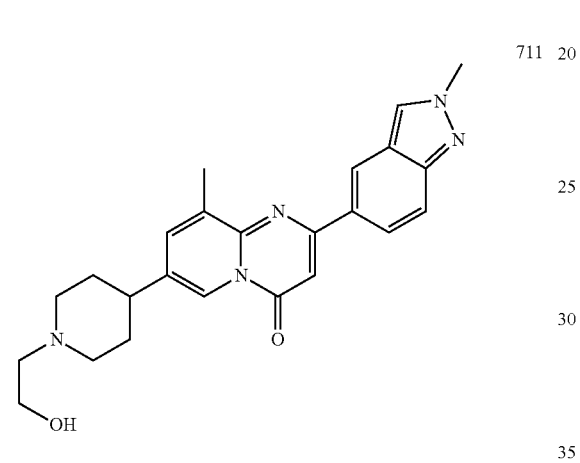
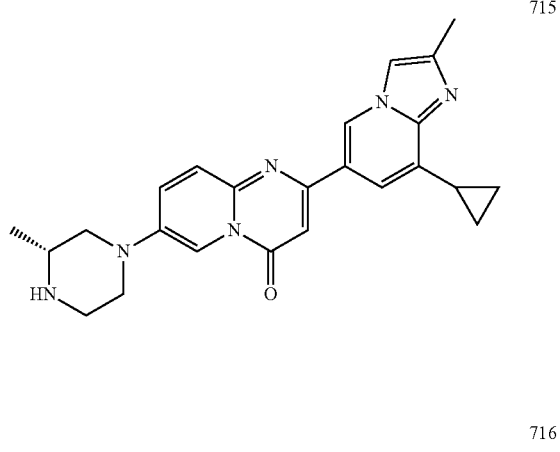
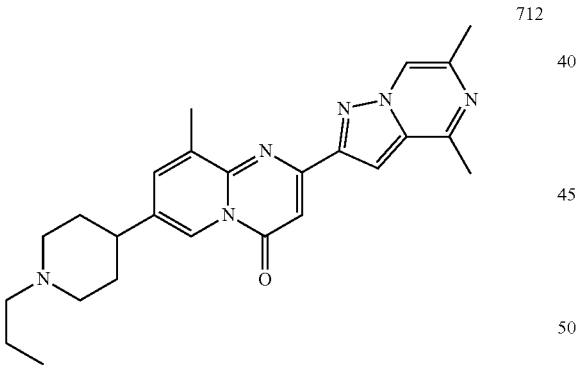
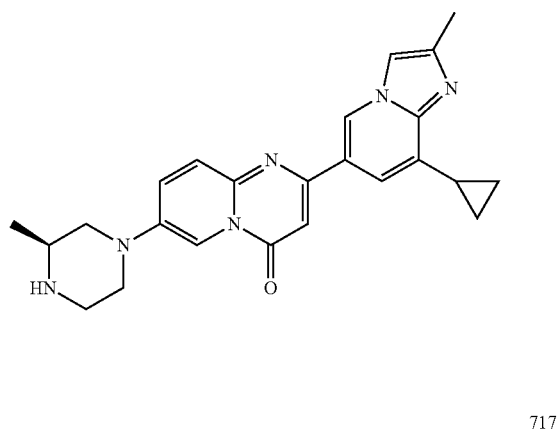
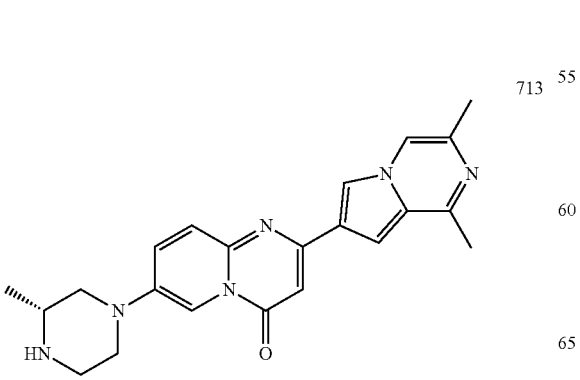
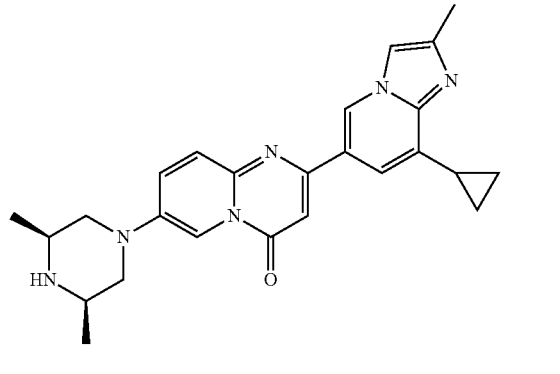

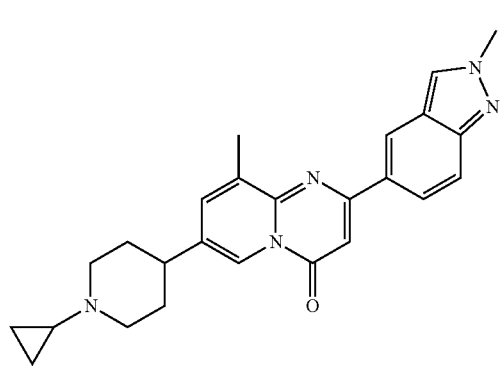
718
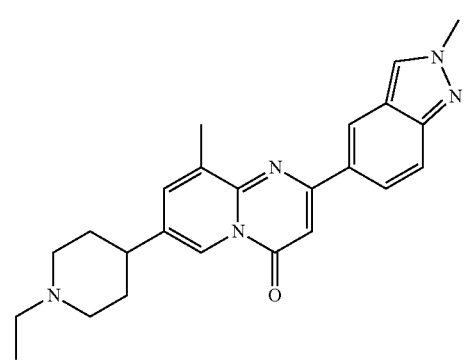
719
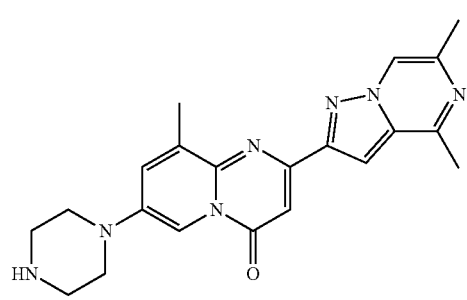
720
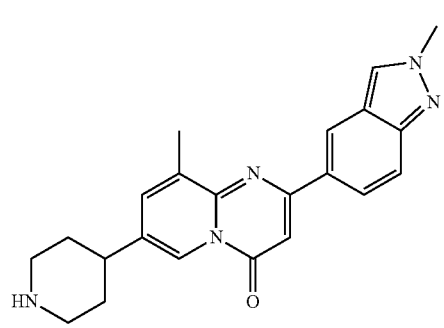
721
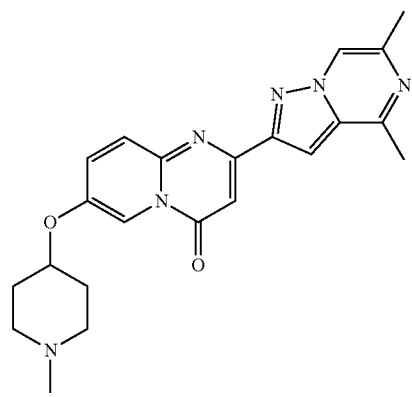
722
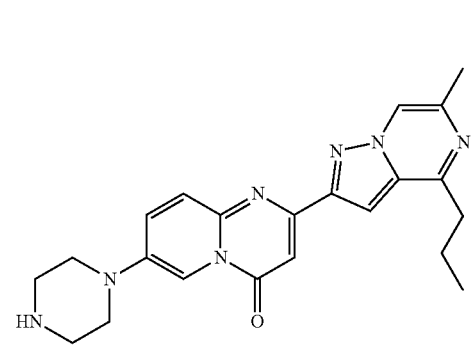
723
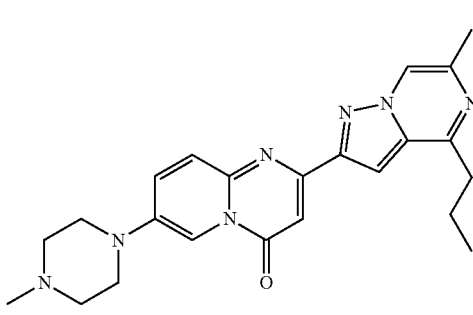
724
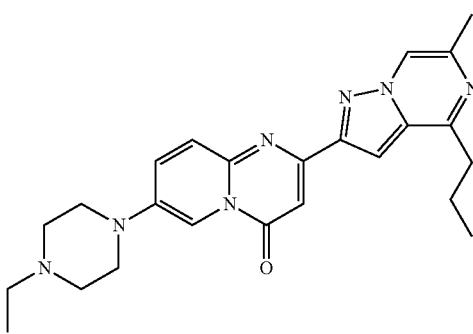
725

726 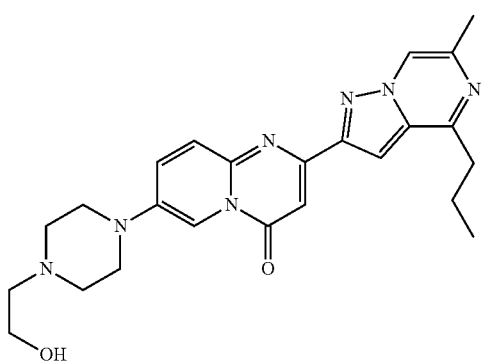
727 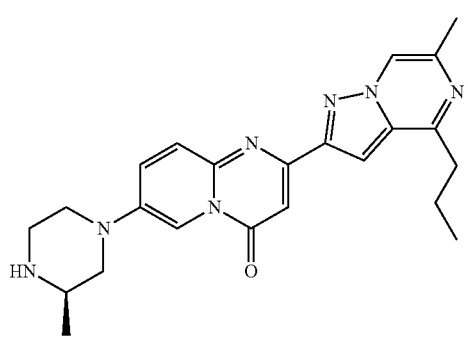
728 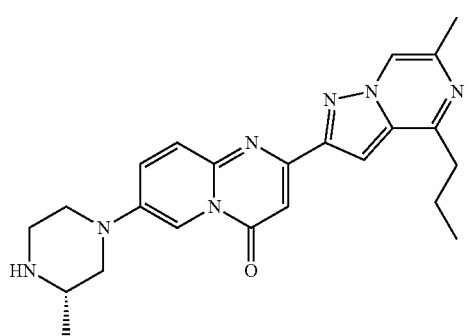
729 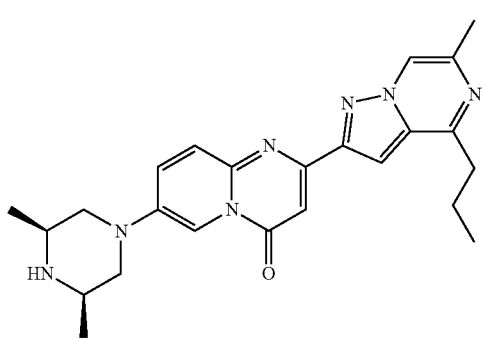
730 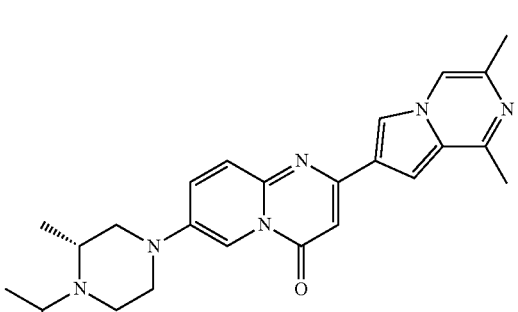
731 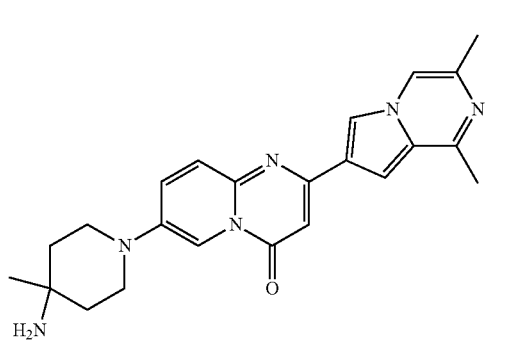
732 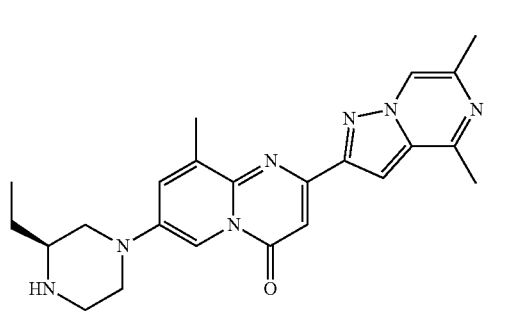
733 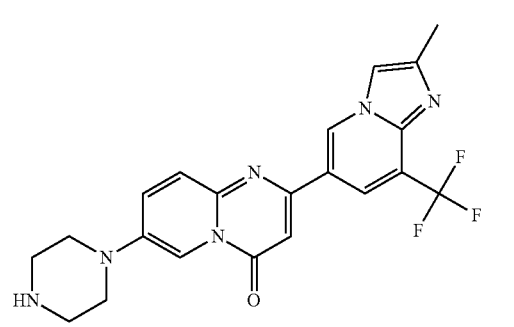
734 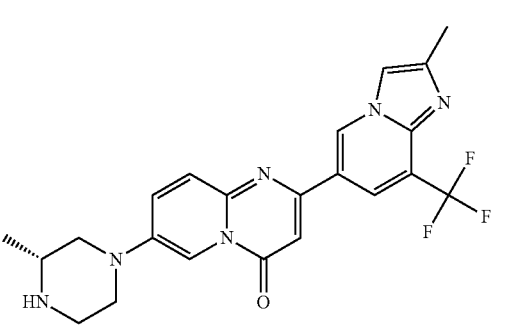

393
-continued
735
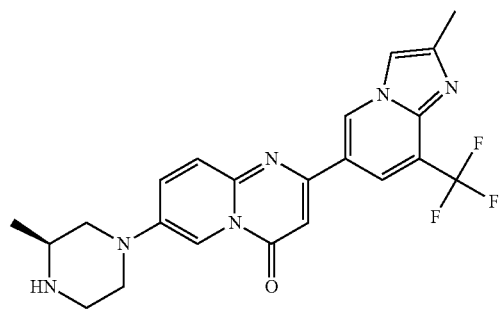
736
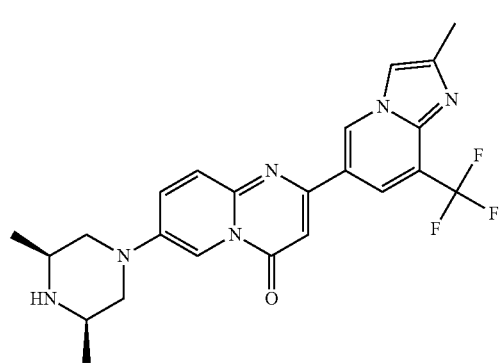
737
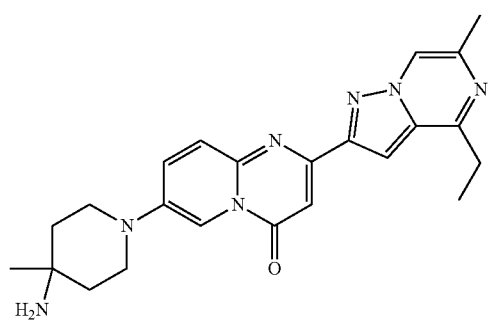
738
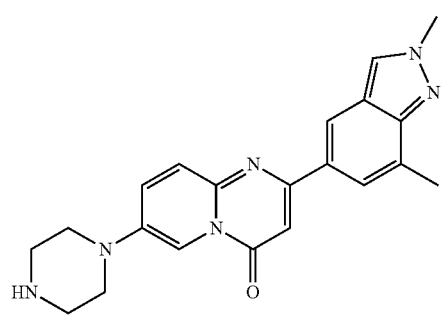
739
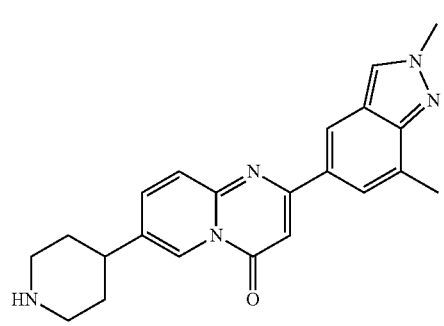
394
-continued
740
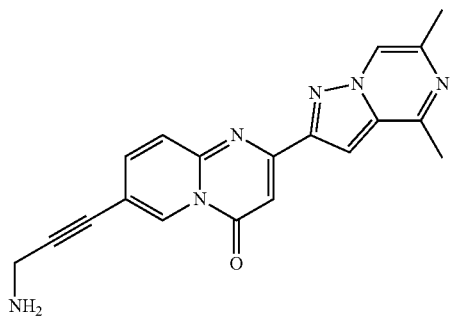
741
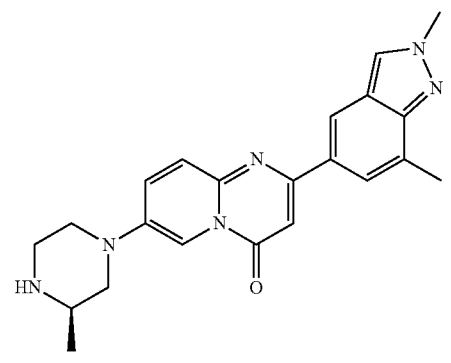
742
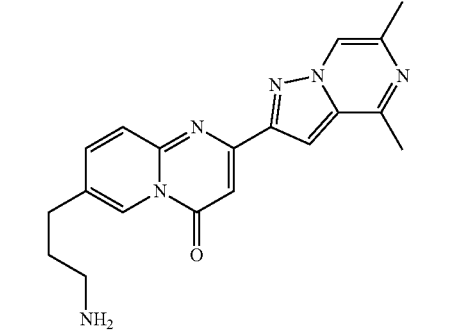
743
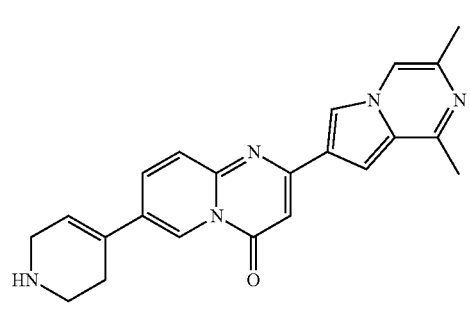
744
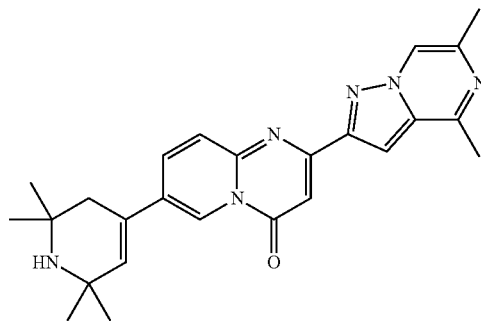

745 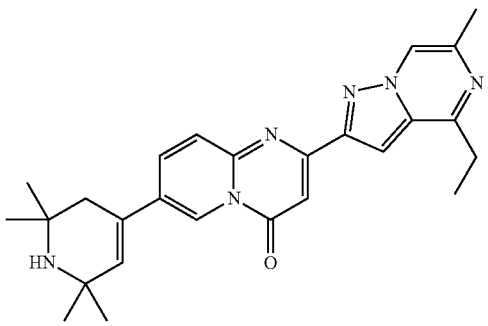
750 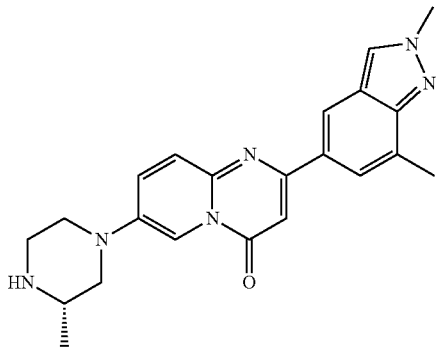
746 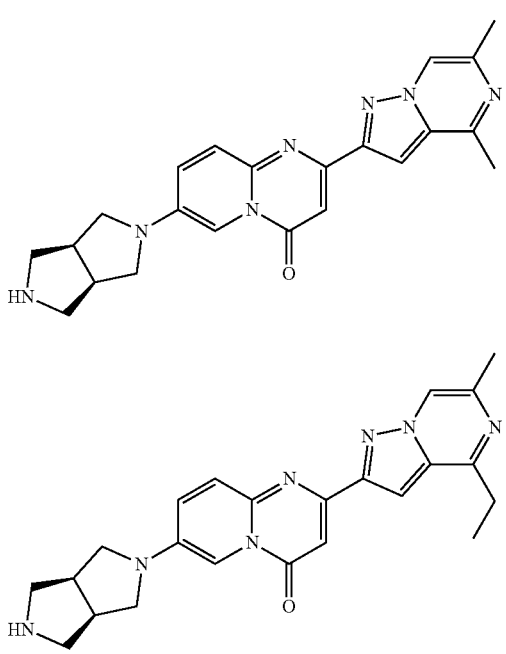
751 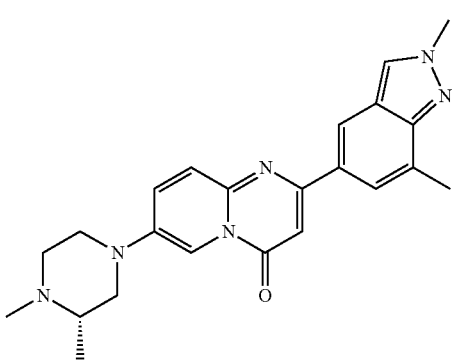
747
748
752 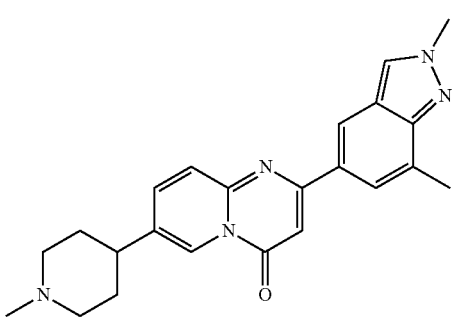
749 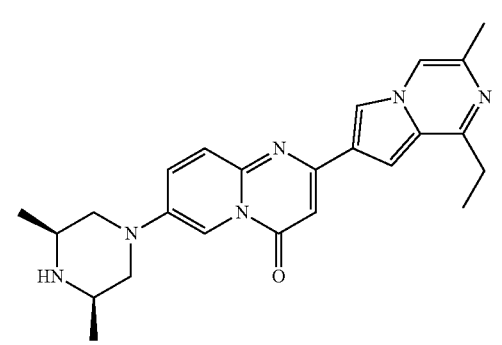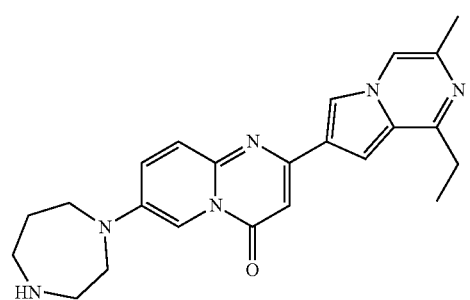
753 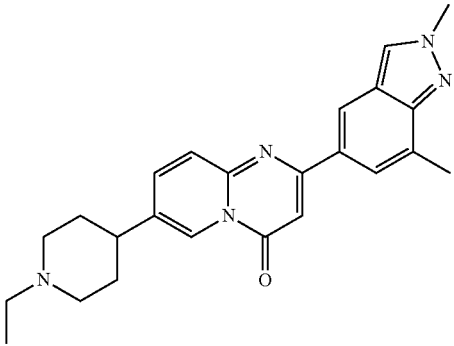

754 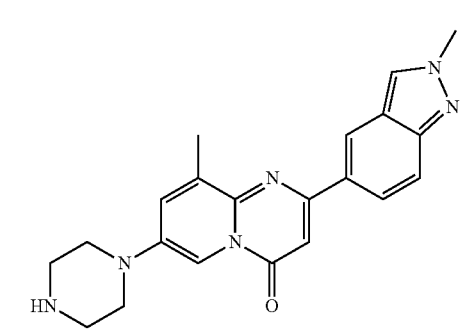
755 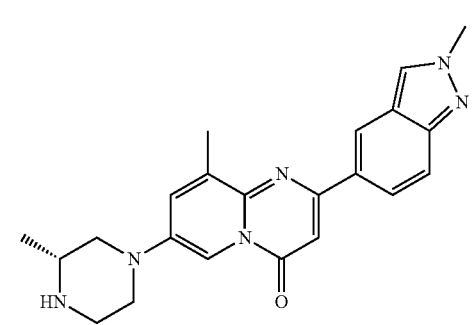
756 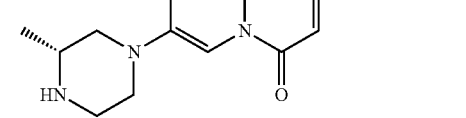
757 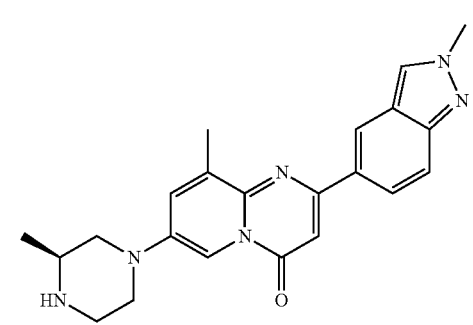
758 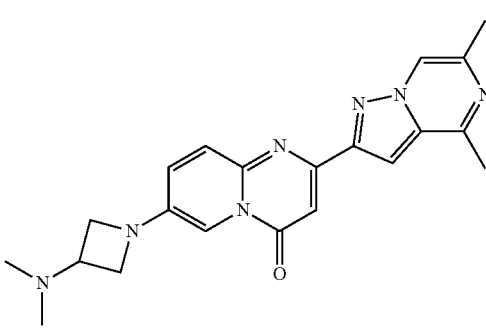
759 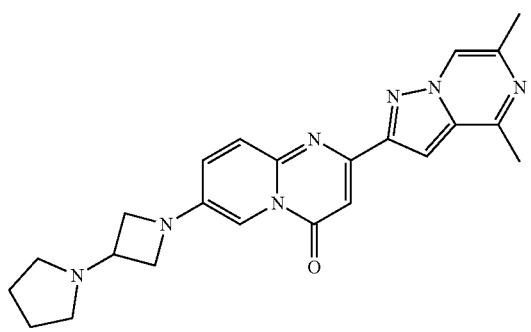
760 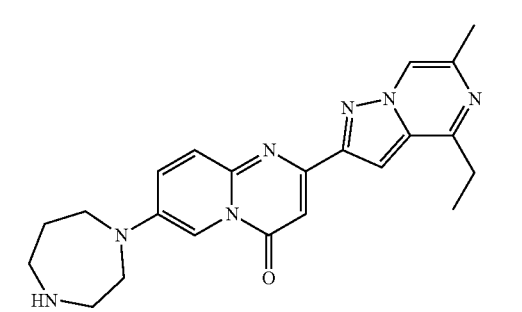
761 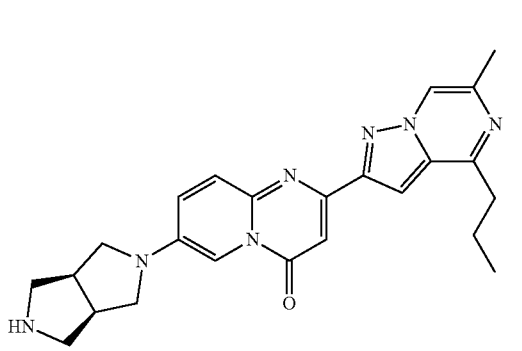
762 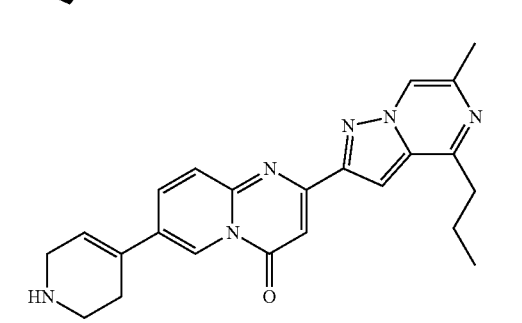
763 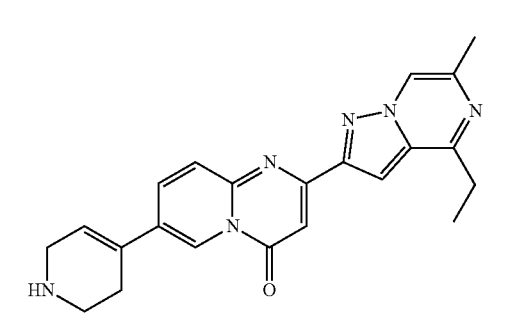

-continued
764
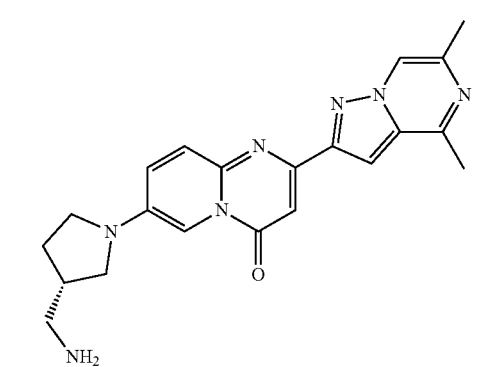
765
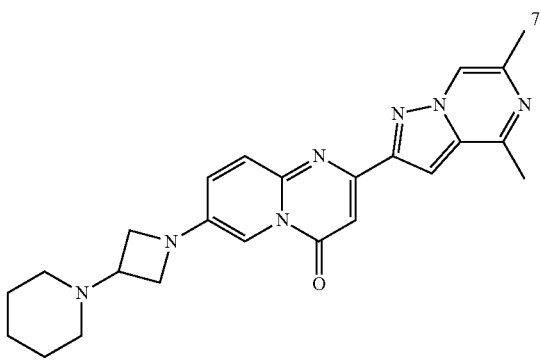
766
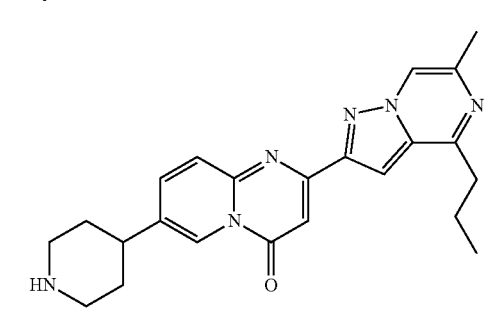
767
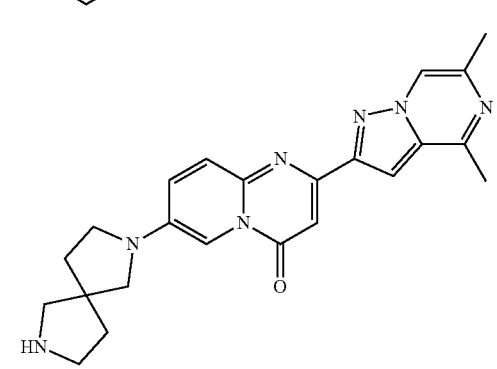
768
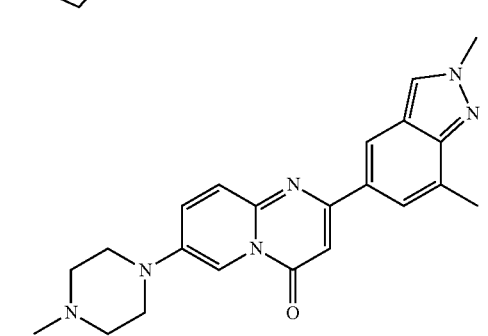
-continued
769
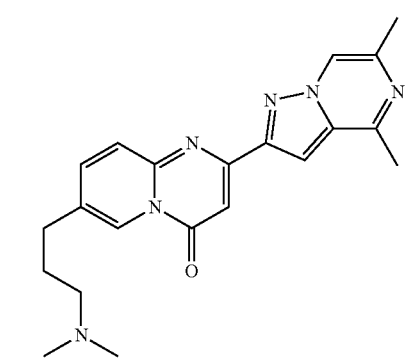
770
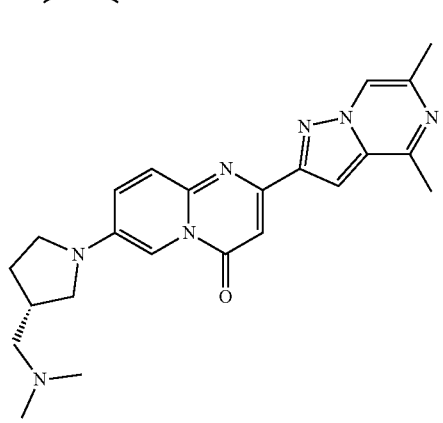
771
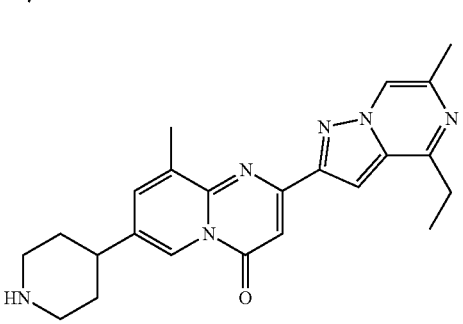
772
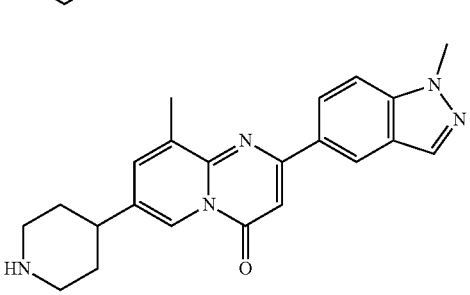
773
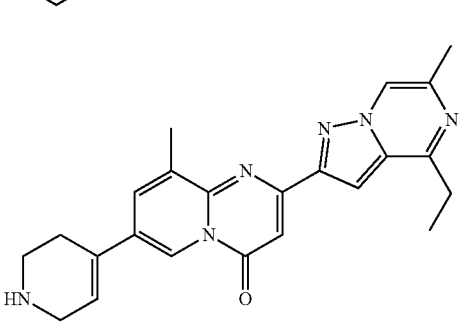

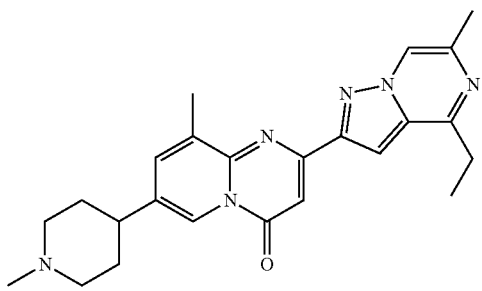
774
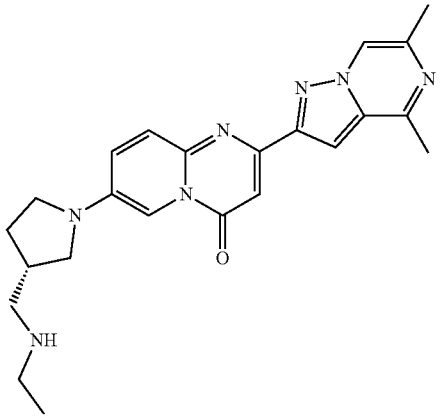
779
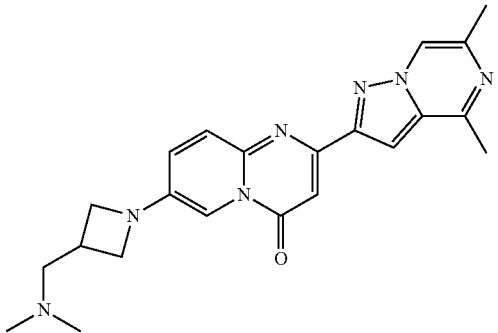
780
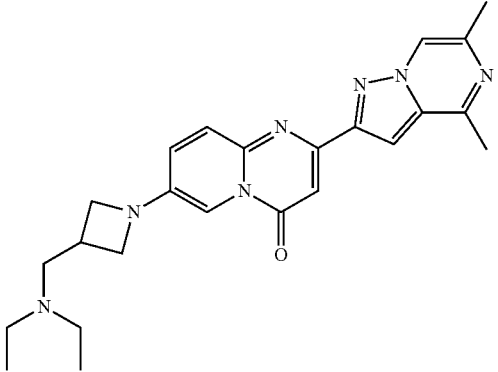
781
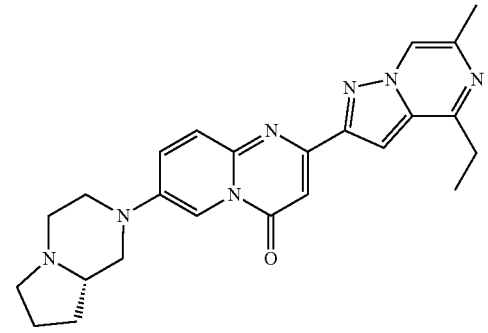
782

783
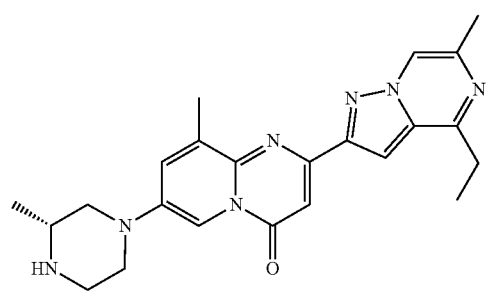
784
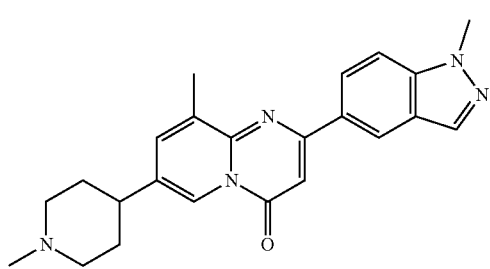
785
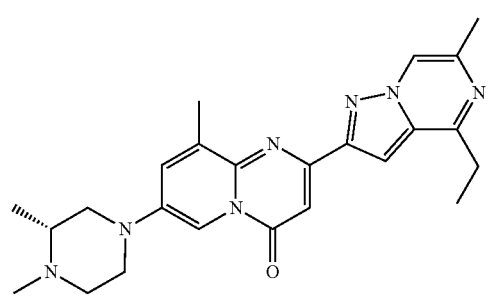
786
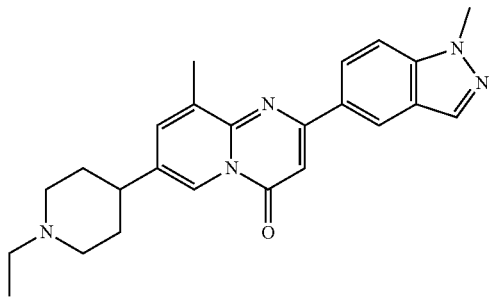
787
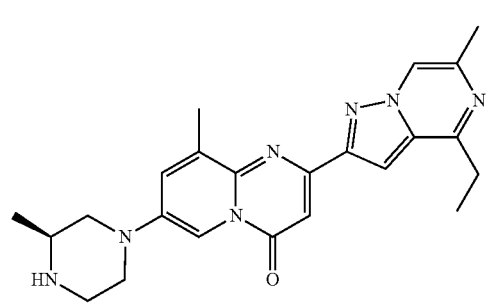
788
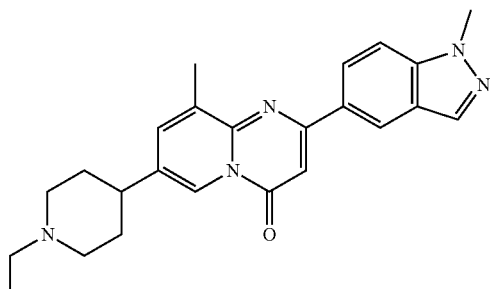
789
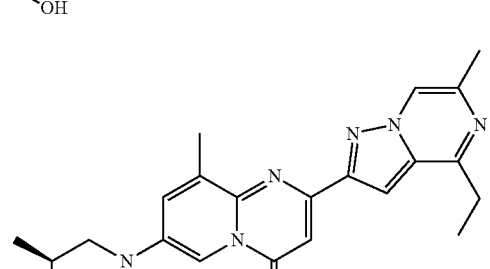
790
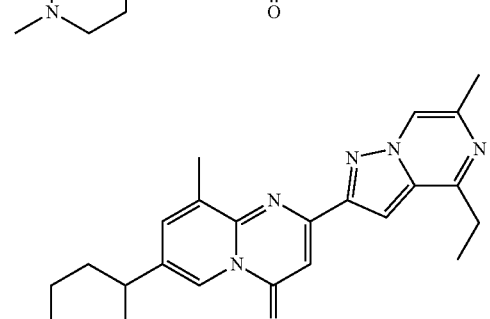
791
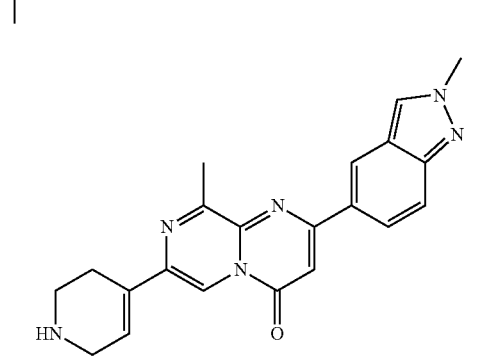
792
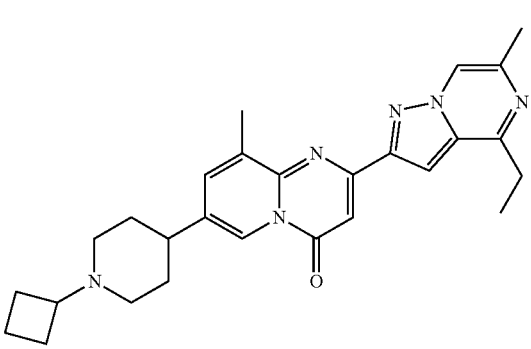

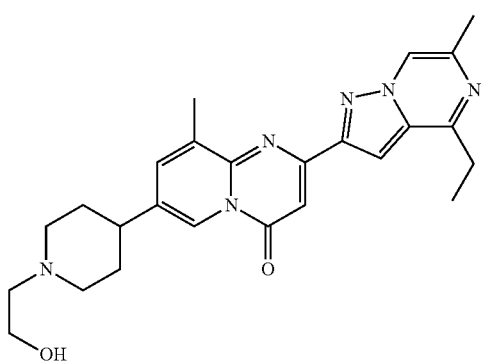
793
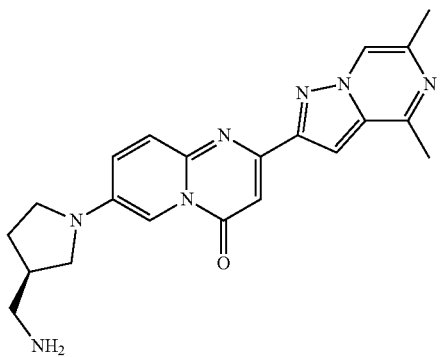
797
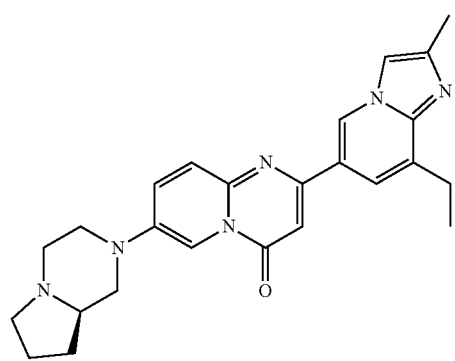
794
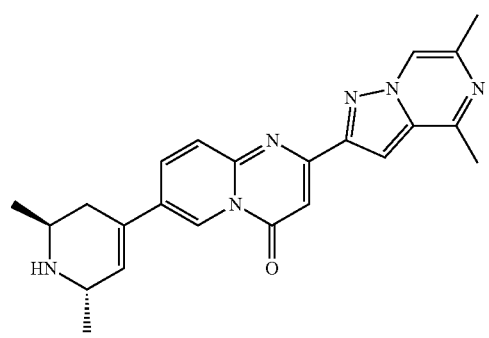
798
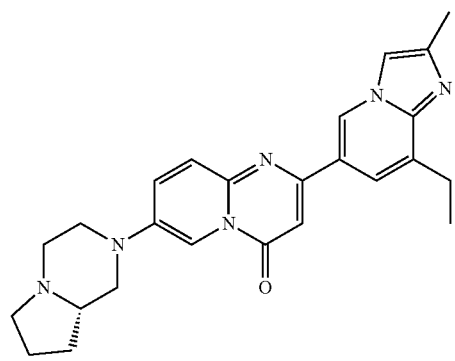
795
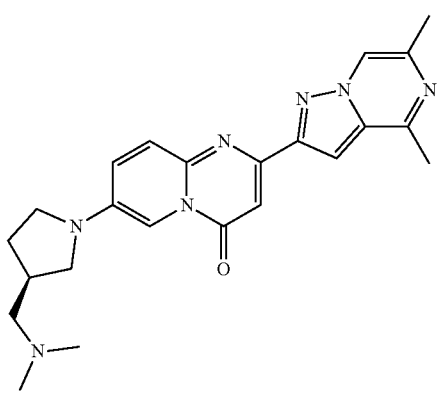
799
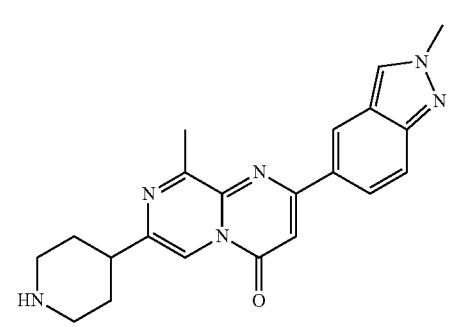
796
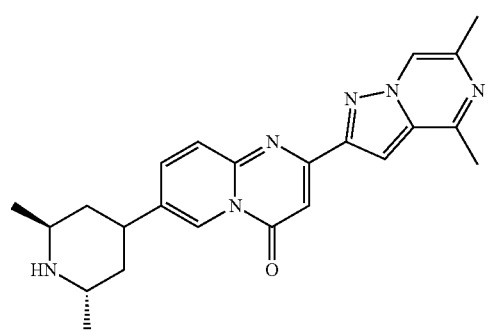
800

801 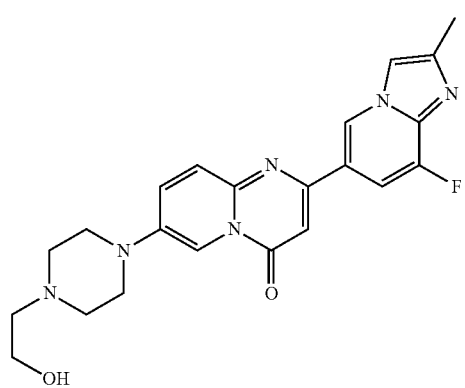
802 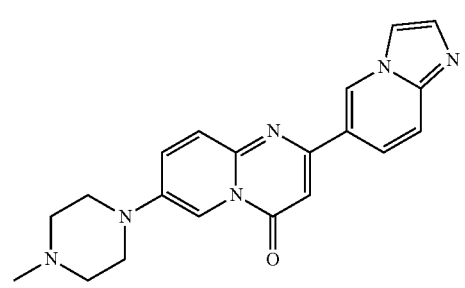
803 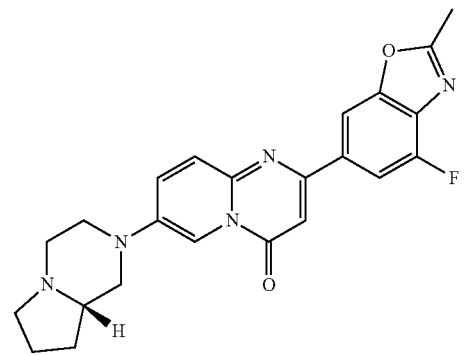
804 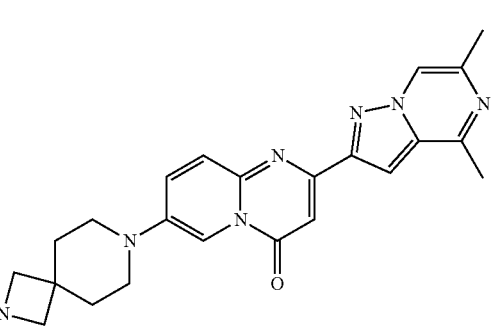
805 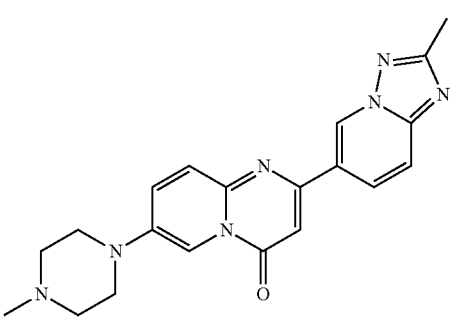
806 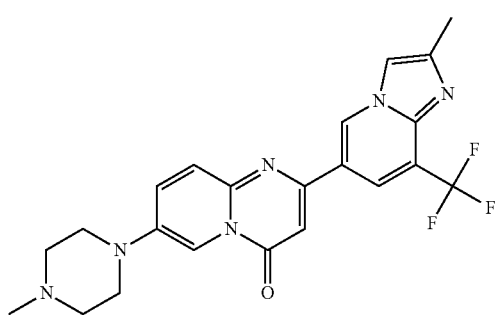
807 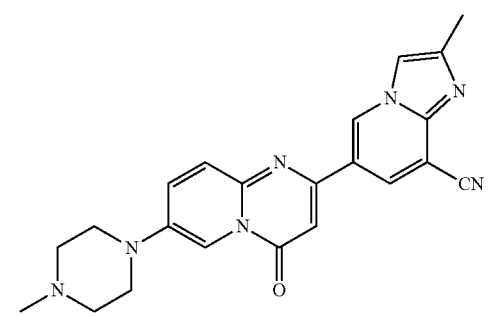
808 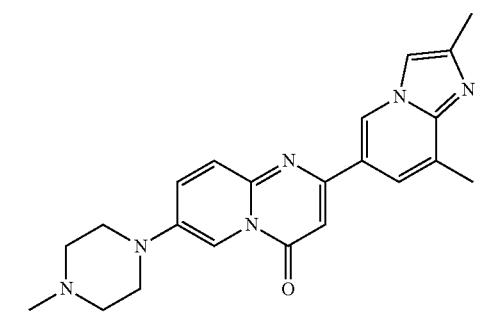
809 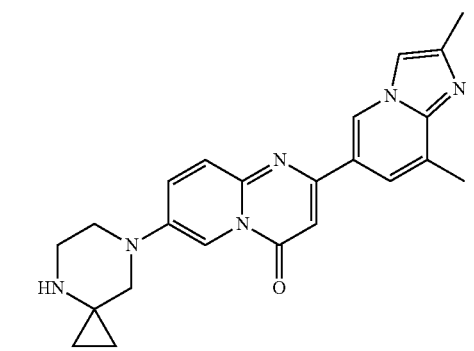

810 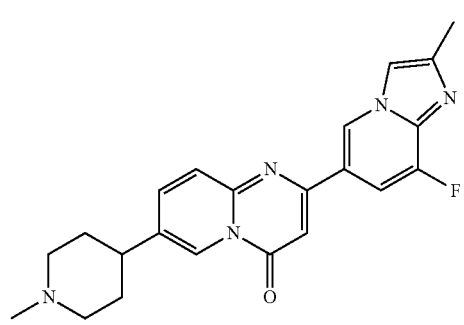
811 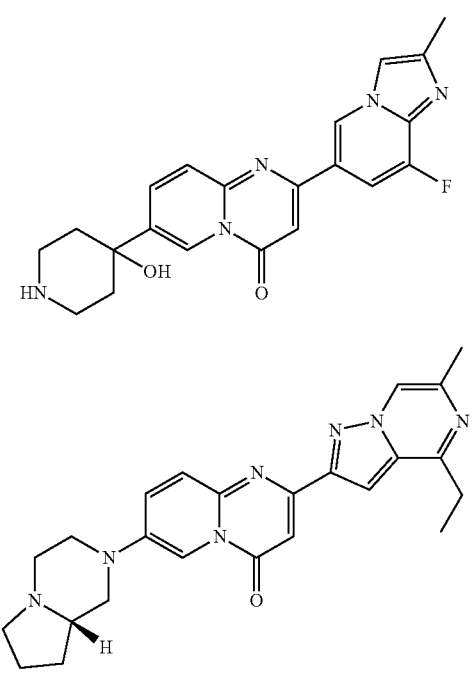
812
813
814 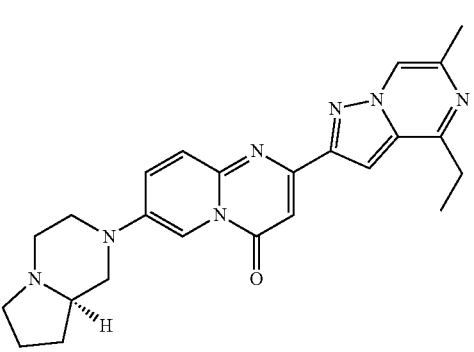
815 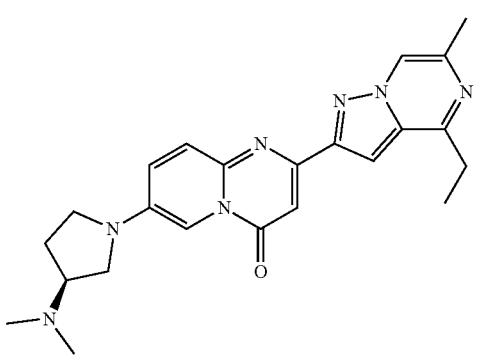
816 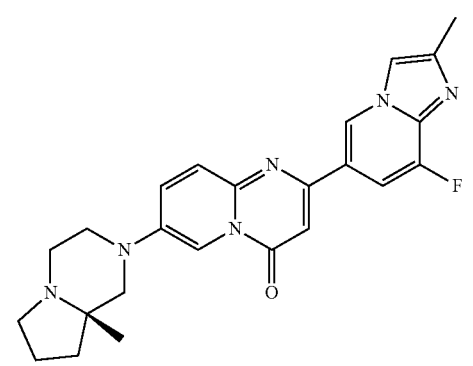
817 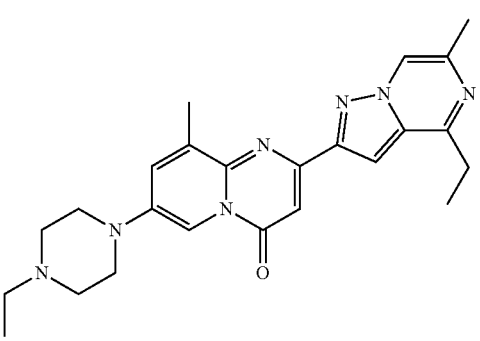
818 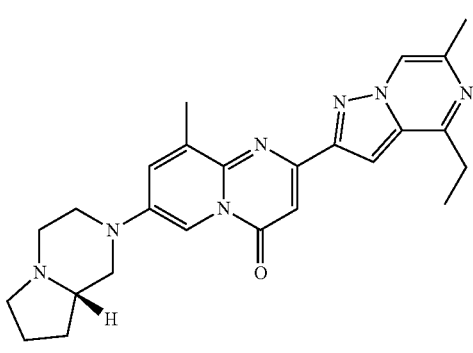

819 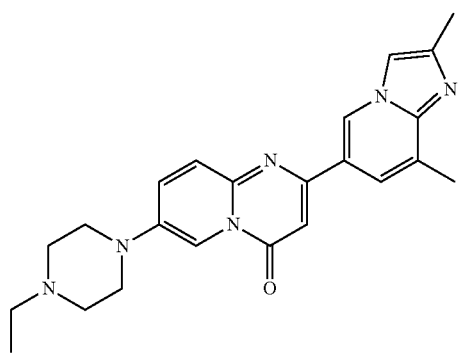
820 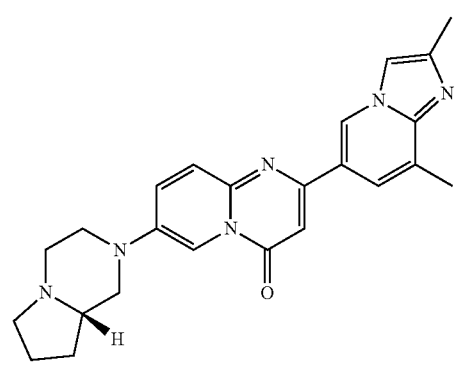
821 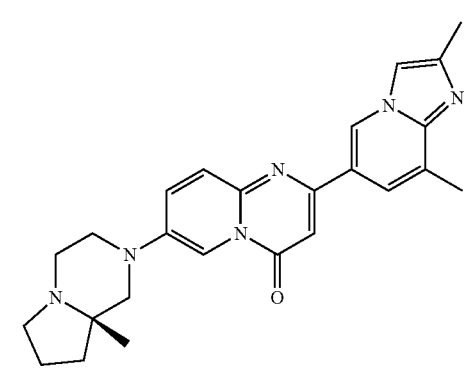
822 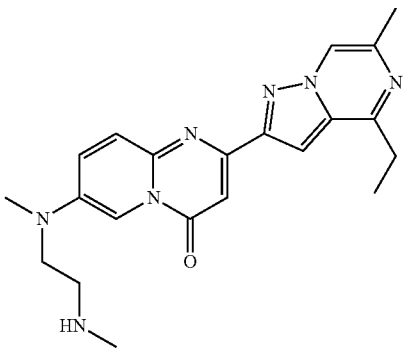
823 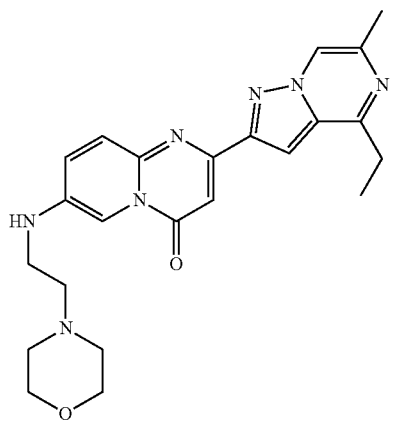
824 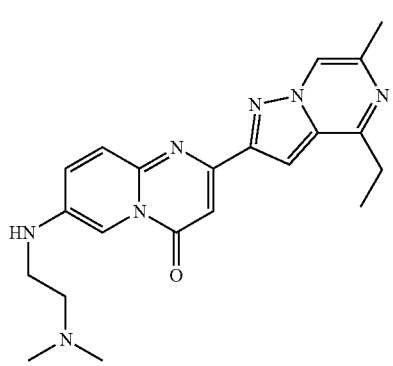
825 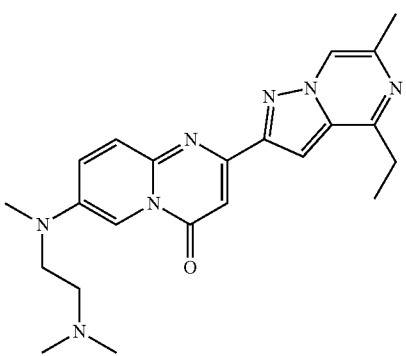
826

827 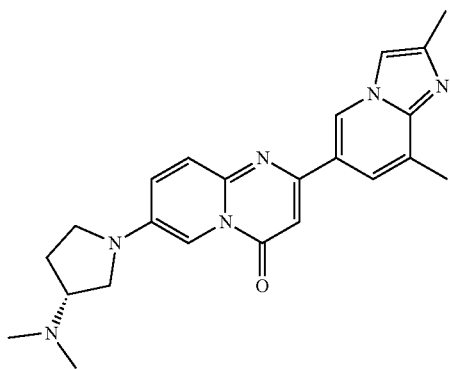
828 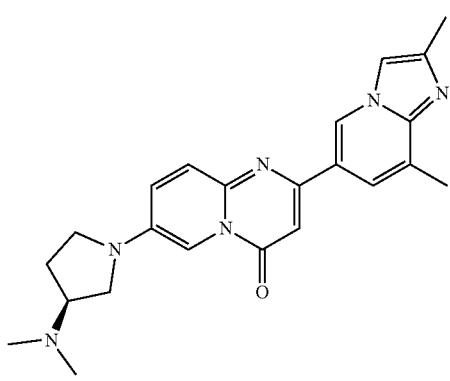
829 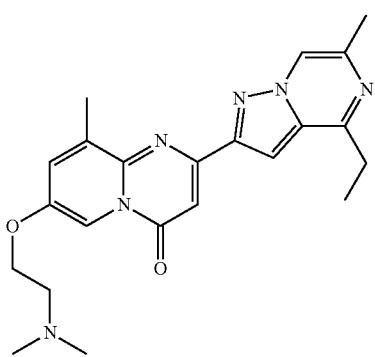
830 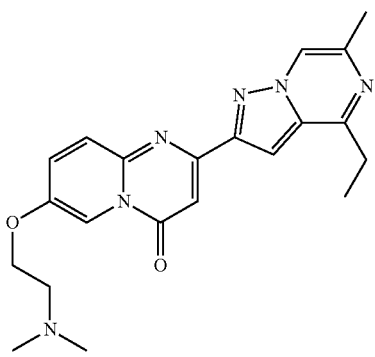
831 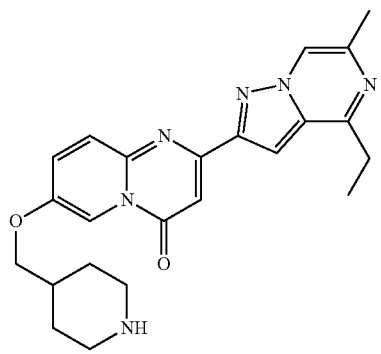
832 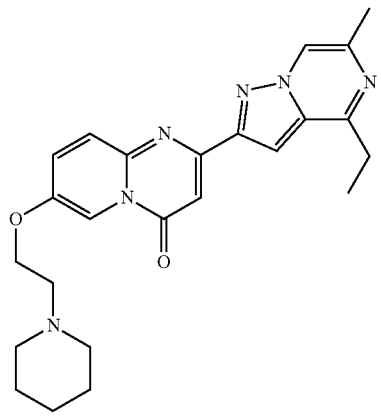
833 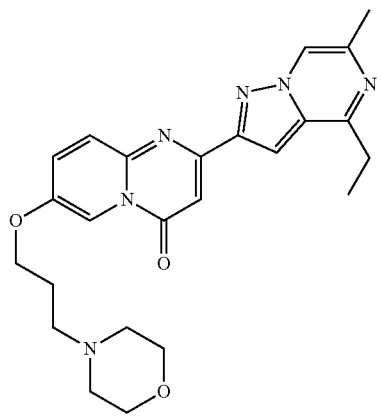
834 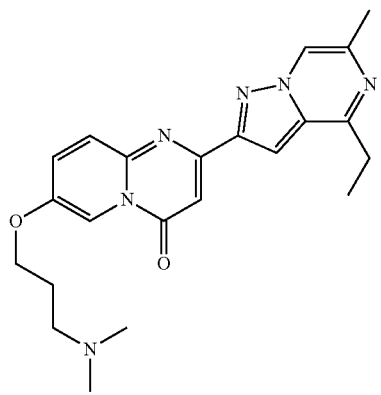

-continued

835

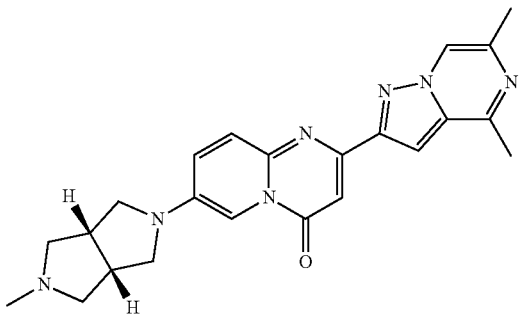

or a form thereof.

In another embodiment, the compound of Formula (I) used in a method disclosed herein is a compound selected from the group consisting of:

2-(4-methoxyphenyl)-7-(piperazin-1-yl)-4H-pyrido[1,2-a]pyrimidin-4-one
2-(4-methoxyphenyl)-7-(4-methylpiperazin-1-yl)-4H-pyrido[1,2-a]pyrimidin-4-one
2-(4-methoxyphenyl)-7-[(3R)-3-methylpiperazin-1-yl]-4H-pyrido[1,2-a]pyrimidin-4-one
7-[(3R,5S)-3,5-dimethylpiperazin-1-yl]-2-(4-methoxyphenyl)-4H-pyrido[1,2-a]pyrimidin-4-one
7-(1,4-diazepan-1-yl)-2-(4-methoxyphenyl)-4H-pyrido[1,2-a]pyrimidin-4-one
2-(3,4-dimethoxyphenyl)-7-(piperazin-1-yl)-4H-pyrido[1,2-a]pyrimidin-4-one
2-(3,4-dimethoxyphenyl)-7-(3,3-dimethylpiperazin-1-yl)-4H-pyrido[1,2-a]pyrimidin-4-one
2-(3,4-dimethoxyphenyl)-7-[(3R)-3-methylpiperazin-1-yl]-4H-pyrido[1,2-a]pyrimidin-4-one
2-(3,4-dimethoxyphenyl)-7-(4-ethylpiperazin-1-yl)-4H-pyrido[1,2-a]pyrimidin-4-one
7-(1,4-diazepan-1-yl)-2-(3,4-dimethoxyphenyl)-4H-pyrido[1,2-a]pyrimidin-4-one
2-(3,4-dimethoxyphenyl)-7-(4-methyl-1,4-diazepan-1-yl)-4H-pyrido[1,2-a]pyrimidin-4-one
2-(4-methoxyphenyl)-7-[(3S)-3-methylpiperazin-1-yl]-4H-pyrido[1,2-a]pyrimidin-4-one
2-(3,4-dimethoxyphenyl)-7-(4-methylpiperazin-1-yl)-4H-pyrido[1,2-a]pyrimidin-4-one
2-(3,4-dimethoxyphenyl)-7-[(3R,5S)-3,5-dimethylpiperazin-1-yl]-4H-pyrido[1,2-a]pyrimidin-4-one
2-(3,4-dimethoxyphenyl)-7-(4-propylpiperazin-1-yl)-4H-pyrido[1,2-a]pyrimidin-4-one
2-(4-methoxyphenyl)-7-(4-methyl-1,4-diazepan-1-yl)-4H-pyrido[1,2-a]pyrimidin-4-one
7-(3,3-dimethylpiperazin-1-yl)-2-(4-methoxyphenyl)-4H-pyrido[1,2-a]pyrimidin-4-one
2-(1,3-benzodioxol-5-yl)-7-(piperazin-1-yl)-4H-pyrido[1,2-a]pyrimidin-4-one
2-(1,3-benzodioxol-5-yl)-7-(4-methylpiperazin-1-yl)-4H-pyrido[1,2-a]pyrimidin-4-one
2-(1,3-benzodioxol-5-yl)-7-[(3R)-3-methylpiperazin-1-yl]-4H-pyrido[1,2-a]pyrimidin-4-one
2-(1,3-benzodioxol-5-yl)-7-[(3R,5S)-3,5-dimethylpiperazin-1-yl]-4H-pyrido[1,2-a]pyrimidin-4-one
2-(3-methoxyphenyl)-7-(piperazin-1-yl)-4H-pyrido[1,2-a]pyrimidin-4-one
2-(3-methoxyphenyl)-7-(4-methylpiperazin-1-yl)-4H-pyrido[1,2-a]pyrimidin-4-one
2-(3-methoxyphenyl)-7-[(3R)-3-methylpiperazin-1-yl]-4H-pyrido[1,2-a]pyrimidin-4-one
7-[(3R,5S)-3,5-dimethylpiperazin-1-yl]-2-(3-methoxyphenyl)-4H-pyrido[1,2-a]pyrimidin-4-one
7-(4-ethylpiperazin-1-yl)-2-(3-methoxyphenyl)-4H-pyrido[1,2-a]pyrimidin-4-one
7-(1,4-diazepan-1-yl)-2-(3-methoxyphenyl)-4H-pyrido[1,2-a]pyrimidin-4-one
2-(3-methoxyphenyl)-7-(4-methyl-1,4-diazepan-1-yl)-4H-pyrido[1,2-a]pyrimidin-4-one
2-(6-methylimidazo[1,2-a]pyridin-2-yl)-7-(piperazin-1-yl)-4H-pyrido[1,2-a]pyrimidin-4-one
2-(3,4-dimethoxyphenyl)-7-[(3S)-3-methylpiperazin-1-yl]-4H-pyrido[1,2-a]pyrimidin-4-one
2-(2,3-dihydro-1,4-benzodioxin-6-yl)-7-(piperazin-1-yl)-4H-pyrido[1,2-a]pyrimidin-4-one
2-(2,3-dihydro-1,4-benzodioxin-6-yl)-7-[(3S)-3-methylpiperazin-1-yl]-4H-pyrido[1,2-a]pyrimidin-4-one
2-phenyl-7-(piperazin-1-yl)-4H-pyrido[1,2-a]pyrimidin-4-one
7-[(3S)-3-methylpiperazin-1-yl]-2-phenyl-4H-pyrido[1,2-a]pyrimidin-4-one
2-(2,3-dihydro-1,4-benzodioxin-6-yl)-7-[(3R)-3-methylpiperazin-1-yl]-4H-pyrido[1,2-a]pyrimidin-4-one
2-(2,3-dihydro-1,4-benzodioxin-6-yl)-7-(3,3-dimethylpiperazin-1-yl)-4H-pyrido[1,2-a]pyrimidin-4-one
2-(2,3-dihydro-1,4-benzodioxin-6-yl)-7-[(3R,5S)-3,5-dimethylpiperazin-1-yl]-4H-pyrido[1,2-a]pyrimidin-4-one
7-(1,4-diazepan-1-yl)-2-(2,3-dihydro-1,4-benzodioxin-6-yl)-4H-pyrido[1,2-a]pyrimidin-4-one
2-(2,3-dihydro-1,4-benzodioxin-6-yl)-7-(4-methyl-1,4-diazepan-1-yl)-4H-pyrido[1,2-a]pyrimidin-4-one
2-(3,4-dimethoxyphenyl)-9-fluoro-7-(4-methylpiperazin-1-yl)-4H-pyrido[1,2-a]pyrimidin-4-one
2-(3-chlorophenyl)-7-(piperazin-1-yl)-4H-pyrido[1,2-a]pyrimidin-4-one
2-(4-chlorophenyl)-7-(piperazin-1-yl)-4H-pyrido[1,2-a]pyrimidin-4-one
7-(piperazin-1-yl)-2-[3-(trifluoromethyl)phenyl]-4H-pyrido[1,2-a]pyrimidin-4-one
7-(piperazin-1-yl)-2-[4-(trifluoromethyl)phenyl]-4H-pyrido[1,2-a]pyrimidin-4-one
2-(3-methylphenyl)-7-(piperazin-1-yl)-4H-pyrido[1,2-a]pyrimidin-4-one
2-(4-fluorophenyl)-7-(piperazin-1-yl)-4H-pyrido[1,2-a]pyrimidin-4-one
2-(4-nitrophenyl)-7-(piperazin-1-yl)-4H-pyrido[1,2-a]pyrimidin-4-one
2-(3,4-dimethoxyphenyl)-9-fluoro-7-(piperidin-4-ylamino)-4H-pyrido[1,2-a]pyrimidin-4-one
2-[4-(dimethylamino)phenyl]-9-fluoro-7-(piperazin-1-yl)-4H-pyrido[1,2-a]pyrimidin-4-one
2-[4-(dimethylamino)phenyl]-9-fluoro-7-[(3R)-3-methylpiperazin-1-yl]-4H-pyrido[1,2-a]pyrimidin-4-one
2-(2-fluorophenyl)-7-(piperazin-1-yl)-4H-pyrido[1,2-a]pyrimidin-4-one
3-(3,4-dimethoxyphenyl)-8-(piperazin-1-yl)-4H-pyrido[1,2-a]pyrimidin-4-one
2-[4-(dimethylamino)phenyl]-7-(piperazin-1-yl)-4H-pyrido[1,2-a]pyrimidin-4-one
2-[4-(dimethylamino)phenyl]-7-[(3S)-3-methylpiperazin-1-yl]-4H-pyrido[1,2-a]pyrimidin-4-one
2-(3,4-dimethylphenyl)-7-(piperazin-1-yl)-4H-pyrido[1,2-a]pyrimidin-4-one
2-(3,4-dimethylphenyl)-7-[(3S)-3-methylpiperazin-1-yl]-4H-pyrido[1,2-a]pyrimidin-4-one 2-[3-(dimethylamino)phenyl]-7-(piperazin-1-yl)-4H-pyrido[1,2-a]pyrimidin-4-one
2-[3-(dimethylamino)phenyl]-7-[(3S)-3-methylpiperazin-1-yl]-4H-pyrido[1,2-a]pyrimidin-4-one
2-[4-(difluoromethoxy)phenyl]-7-(piperazin-1-yl)-4H-pyrido[1,2-a]pyrimidin-4-one
2-[4-(difluoromethoxy)phenyl]-7-[(3S)-3-methylpiperazin-1-yl]-4H-pyrido[1,2-a]pyrimidin-4-one
2-(3-fluorophenyl)-7-(piperazin-1-yl)-4H-pyrido[1,2-a]pyrimidin-4-one
2-(3-nitrophenyl)-7-(piperazin-1-yl)-4H-pyrido[1,2-a]pyrimidin-4-one
2-(4-methylphenyl)-7-(piperazin-1-yl)-4H-pyrido[1,2-a]pyrimidin-4-one
2-(2-fluoro-4,5-dimethoxyphenyl)-7-(piperazin-1-yl)-4H-pyrido[1,2-a]pyrimidin-4-one
2-(2-fluoro-4,5-dimethoxyphenyl)-7-[(3S)-3-methylpiperazin-1-yl]-4H-pyrido[1,2-a]pyrimidin-4-one
7-(3,8-diazabicyclo[3.2.1]oct-3-yl)-2-(3,4-dimethoxyphenyl)-4H-pyrido[1,2-a]pyrimidin-4-one
2-[4-methoxy-3-(trifluoromethyl)phenyl]-7-(piperazin-1-yl)-4H-pyrido[1,2-a]pyrimidin-4-one
2-[4-methoxy-3-(trifluoromethyl)phenyl]-7-[(3R)-3-methylpiperazin-1-yl]-4H-pyrido[1,2-a]pyrimidin-4-one
2-[4-methoxy-3-(trifluoromethyl)phenyl]-7-[(3S)-3-methylpiperazin-1-yl]-4H-pyrido[1,2-a]pyrimidin-4-one
2-(3,4-dimethoxyphenyl)-9-methoxy-7-(piperazin-1-yl)-4H-pyrido[1,2-a]pyrimidin-4-one
2-(3,5-difluoro-4-hydroxyphenyl)-7-(piperazin-1-yl)-4H-pyrido[1,2-a]pyrimidin-4-one
2-(3-fluoro-4-methoxyphenyl)-7-(piperazin-1-yl)-4H-pyrido[1,2-a]pyrimidin-4-one
4-[4-oxo-7-(piperazin-1-yl)-4H-pyrido[1,2-a]pyrimidin-2-yl]benzonitrile
2-(6-methylimidazo[1,2-a]pyrazin-2-yl)-7-(piperazin-1-yl)-4H-pyrido[1,2-a]pyrimidin-4-one
2-(6-methylimidazo[1,2-a]pyrazin-2-yl)-7-[(3S)-3-methylpiperazin-1-yl]-4H-pyrido[1,2-a]pyrimidin-4-one
2-[3-fluoro-5-(trifluoromethyl)phenyl]-7-(piperazin-1-yl)-4H-pyrido[1,2-a]pyrimidin-4-one
2-[4-fluoro-3-(trifluoromethyl)phenyl]-7-(piperazin-1-yl)-4H-pyrido[1,2-a]pyrimidin-4-one
2-[2-methoxy-3-(trifluoromethyl)phenyl]-7-(piperazin-1-yl)-4H-pyrido[1,2-a]pyrimidin-4-one
2-(3,5-difluorophenyl)-7-(piperazin-1-yl)-4H-pyrido[1,2-a]pyrimidin-4-one
7-(piperazin-1-yl)-2-[3-(trifluoromethoxy)phenyl]-4H-pyrido[1,2-a]pyrimidin-4-one
2-[4-methoxy-3-(trifluoromethoxy)phenyl]-7-(piperazin-1-yl)-4H-pyrido[1,2-a]pyrimidin-4-one
2-[4-hydroxy-3-(trifluoromethoxy)phenyl]-7-(piperazin-1-yl)-4H-pyrido[1,2-a]pyrimidin-4-one
2-[4-methoxy-3-(trifluoromethoxy)phenyl]-7-[(3S)-3-methylpiperazin-1-yl]-4H-pyrido[1,2-a]pyrimidin-4-one
2-[4-hydroxy-3-(trifluoromethoxy)phenyl]-7-[(3S)-3-methylpiperazin-1-yl]-4H-pyrido[1,2-a]pyrimidin-4-one
2-(3,4-dimethoxyphenyl)-4-oxo-7-(piperazin-1-yl)-4H-quinolizine-1-carbonitrile
2-(3-fluoro-4-methoxyphenyl)-7-[(3R)-3-methylpiperazin-1-yl]-4H-pyrido[1,2-a]pyrimidin-4-one
2-(3-fluoro-4-methoxyphenyl)-7-[(3S)-3-methylpiperazin-1-yl]-4H-pyrido[1,2-a]pyrimidin-4-one
2-(6-methoxypyridin-3-yl)-7-(piperazin-1-yl)-4H-pyrido[1,2-a]pyrimidin-4-one
2-(2,4-dimethoxyphenyl)-7-(piperazin-1-yl)-4H-pyrido[1,2-a]pyrimidin-4-one
2-(2,4-dimethoxyphenyl)-7-[(3S)-3-methylpiperazin-1-yl]-4H-pyrido[1,2-a]pyrimidin-4-one
2-(3,4-dimethoxyphenyl)-7-[(3S)-3-methylpiperazin-1-yl]-4H-quinolizin-4-one
2-(5-fluoropyridin-3-yl)-7-(piperazin-1-yl)-4H-pyrido[1,2-a]pyrimidin-4-one
2-(5-fluoropyridin-3-yl)-7-[(3S)-3-methylpiperazin-1-yl]-4H-pyrido[1,2-a]pyrimidin-4-one
2-(5-chloropyridin-3-yl)-7-(piperazin-1-yl)-4H-pyrido[1,2-a]pyrimidin-4-one
2-(5-chloropyridin-3-yl)-7-[(3S)-3-methylpiperazin-1-yl]-4H-pyrido[1,2-a]pyrimidin-4-one
2-(5-chloro-6-methoxypyridin-3-yl)-7-(piperazin-1-yl)-4H-pyrido[1,2-a]pyrimidin-4-one
2-(1H-indol-6-yl)-7-(piperazin-1-yl)-4H-pyrido[1,2-a]pyrimidin-4-one
2-(1H-indol-5-yl)-7-(piperazin-1-yl)-4H-pyrido[1,2-a]pyrimidin-4-one
2-[3-(difluoromethoxy)-4-methoxyphenyl]-7-(piperazin-1-yl)-4H-pyrido[1,2-a]pyrimidin-4-one
2-[3-(difluoromethoxy)-4-hydroxyphenyl]-7-(piperazin-1-yl)-4H-pyrido[1,2-a]pyrimidin-4-one
2-[3-(difluoromethoxy)-4-methoxyphenyl]-7-[(3S)-3-methylpiperazin-1-yl]-4H-pyrido[1,2-a]pyrimidin-4-one
2-[3-(difluoromethoxy)-4-hydroxyphenyl]-7-[(3S)-3-methylpiperazin-1-yl]-4H-pyrido[1,2-a]pyrimidin-4-one
2-(3-fluoro-4-methoxyphenyl)-7-(piperazin-1-yl)-4H-quinolizin-4-one
2-(3-fluoro-4-methoxyphenyl)-7-[(3S)-3-methylpiperazin-1-yl]-4H-quinolizin-4-one
2-(3,5-difluorophenyl)-7-[(3S)-3-methylpiperazin-1-yl]-4H-pyrido[1,2-a]pyrimidin-4-one
2-(3,4-dimethoxyphenyl)-7-(piperazin-1-yl)-4H-quinolizin-4-one
2-(imidazo[1,2-a]pyridin-7-yl)-7-(piperazin-1-yl)-4H-pyrido[1,2-a]pyrimidin-4-one
2-(imidazo[1,2-a]pyridin-6-yl)-7-(piperazin-1-yl)-4H-pyrido[1,2-a]pyrimidin-4-one
2-(2-methylimidazo[1,2-a]pyridin-6-yl)-7-(piperazin-1-yl)-4H-pyrido[1,2-a]pyrimidin-4-one
2-(3-chloro-4-methoxyphenyl)-7-(piperazin-1-yl)-4H-pyrido[1,2-a]pyrimidin-4-one
2-(3-chloro-4-methoxyphenyl)-7-[(3S)-3-methylpiperazin-1-yl]-4H-pyrido[1,2-a]pyrimidin-4-one
2-(3-ethoxy-4-methoxyphenyl)-7-(piperazin-1-yl)-4H-pyrido[1,2-a]pyrimidin-4-one
2-(3-ethoxy-4-methoxyphenyl)-7-[(3S)-3-methylpiperazin-1-yl]-4H-pyrido[1,2-a]pyrimidin-4-one
2-(2-methylimidazo[1,2-a]pyridin-6-yl)-7-(4-methylpiperazin-1-yl)-4H-pyrido[1,2-a]pyrimidin-4-one
2-(2-methylimidazo[1,2-a]pyridin-6-yl)-7-[(3S)-3-methylpiperazin-1-yl]-4H-pyrido[1,2-a]pyrimidin-4-one
7-(1,4-diazepan-1-yl)-2-(2-methylimidazo[1,2-a]pyridin-6-yl)-4H-pyrido[1,2-a]pyrimidin-4-one
7-[(3R,5S)-3,5-dimethylpiperazin-1-yl]-2-(2-methylimidazo[1,2-a]pyridin-6-yl)-4H-pyrido[1,2-a]pyrimidin-4-one
2-(6,8-dimethylimidazo[1,2-a]pyrazin-2-yl)-7-(piperazin-1-yl)-4H-pyrido[1,2-a]pyrimidin-4-one
2-(6,8-dimethylimidazo[1,2-a]pyrazin-2-yl)-7-[(3S)-3-methylpiperazin-1-yl]-4H-pyrido[1,2-a]pyrimidin-4-one
2-(4,6-dimethylpyrazolo[1,5-a]pyrazin-2-yl)-7-(piperazin-1-yl)-4H-pyrido[1,2-a]pyrimidin-4-one
2-(4,6-dimethylpyrazolo[1,5-a]pyrazin-2-yl)-7-[(3S)-3-methylpiperazin-1-yl]-4H-pyrido[1,2-a]pyrimidin-4-one
2-(3,4-dimethoxyphenyl)-7-(2-methylpyridin-4-yl)-4H-pyrido[1,2-a]pyrimidin-4-one 7-(piperazin-1-yl)-2-[2-(trifluoromethyl)imidazo[1,2-a]
pyridin-6-yl]-4H-pyrido[1,2-a]pyrimidin-4-one
2-(2-ethylimidazo[1,2-a]pyridin-6-yl)-7-(piperazin-1-yl)-
4H-pyrido[1,2-a]pyrimidin-4-one
2-(2,3-dimethylimidazo[1,2-a]pyridin-6-yl)-7-(piperazin-1-
yl)-4H-pyrido[1,2-a]pyrimidin-4-one
2-(3,4-dimethoxyphenyl)-7-[(3 aR,6aS)-hexahydropyrrolo
[3,4-c]pyrrol-2(1H)-yl]-4H-pyrido[1,2-a]pyrimidin-4-
one
7-(4-aminopiperidin-1-yl)-2-(3,4-dimethoxyphenyl)-4H-
pyrido[1,2-a]pyrimidin-4-one
7-(piperazin-1-yl)-2-(1H-pyrrolo[2,3-b]pyridin-5-yl)-4H-
pyrido[1,2-a]pyrimidin-4-one
2-(1-methyl-1H-pyrrolo[2,3-b]pyridin-5-yl)-7-(piperazin-1-
yl)-4H-pyrido[1,2-a]pyrimidin-4-one
7-[(3R,5S)-3,5-dimethylpiperazin-1-yl]-2-(1-methyl-1H-
pyrrolo[2,3-b]pyridin-5-yl)-4H-pyrido[1,2-a]pyrimidin-
4-one
7-[(3R,5S)-3,5-dimethylpiperazin-1-yl]-2-(4,6-dimeth-
ylpyrazolo[1,5-a]pyrazin-2-yl)-4H-pyrido[1,2-a]pyrimi-
din-4-one
7-(1,4-diazepan-1-yl)-2-(4,6-dimethylpyrazolo[1,5-a]
pyrazin-2-yl)-4H-pyrido[1,2-a]pyrimidin-4-one
2-(2-methyl-1,3-benzoxazol-6-yl)-7-(piperazin-1-yl)-4H-
pyrido[1,2-a]pyrimidin-4-one
2-(2-methyl-1,3-benzoxazol-6-yl)-7-[(3S)-3-methylpiper-
azin-1-yl]-4H-pyrido[1,2-a]pyrimidin-4-one
2-(2-methyl-1,3-benzothiazol-5-yl)-7-[(3S)-3-methylpiper-
azin-1-yl]-4H-pyrido[1,2-a]pyrimidin-4-one
2-(2-methyl-1,3-benzothiazol-5-yl)-7-(piperazin-1-yl)-4H-
pyrido[1,2-a]pyrimidin-4-one
2-(2-methyl-2H-indazol-5-yl)-7-(piperazin-1-yl)-4H-pyrido
[1,2-a]pyrimidin-4-one
2-(2-methyl-2H-indazol-5-yl)-7-[(3S)-3-methylpiperazin-1-
yl]-4H-pyrido[1,2-a]pyrimidin-4-one
2-(3-fluoro-5-methoxyphenyl)-7-(piperazin-1-yl)-4H-
pyrido[1,2-a]pyrimidin-4-one
2-(3-fluoro-5-methoxyphenyl)-7-[(3S)-3-methylpiperazin-
1-yl]-4H-pyrido[1,2-a]pyrimidin-4-one
2-(2,8-dimethylimidazo[1,2-a]pyridin-6-yl)-7-(piperazin-1-
yl)-4H-pyrido[1,2-a]pyrimidin-4-one
2-(3,4-dimethoxyphenyl)-9-methyl-7-[(3S)-3-methylpiper-
azin-1-yl]-4H-pyrido[1,2-a]pyrimidin-4-one
2-(3,4-dimethoxyphenyl)-7-(1,2,3,6-tetrahydropyridin-4-
yl)-4H-pyrido[1,2-a]pyrimidin-4-one
2-(3,4-dimethoxyphenyl)-7-(piperidin-4-yl)-4H-pyrido[1,2-
a]pyrimidin-4-one
2-(3-fluoro-4,5-dimethoxyphenyl)-7-(piperazin-1-yl)-4H-
pyrido[1,2-a]pyrimidin-4-one
2-(3,4-dimethoxyphenyl)-7-(4-hydroxypiperazin-1-yl)-4H-
pyrido[1,2-a]pyrimidin-4-one
2-(3,4-dimethoxyphenyl)-7-[(3S)-3-(dimethylamino)pyrro-
lidin-1-yl]-4H-pyrido[1,2-a]pyrimidin-4-one
2-(3,4-dimethoxyphenyl)-7-[4-(dimethylamino)piperidin-1-
yl]-4H-pyrido[1,2-a]pyrimidin-4-one
2-(4-methoxy-3-methylphenyl)-7-(piperazin-1-yl)-4H-
pyrido[1,2-a]pyrimidin-4-one
3-[4-oxo-7-(piperazin-1-yl)-4H-pyrido[1,2-a]pyrimidin-2-
yl]benzonitrile
2-methoxy-5-[4-oxo-7-(piperazin-1-yl)-4H-pyrido[1,2-a]
pyrimidin-2-yl]benzonitrile
2-(3-fluoro-4-hydroxyphenyl)-7-(piperazin-1-yl)-4H-pyrido
[1,2-a]pyrimidin-4-one
2-(4-ethoxy-3-fluorophenyl)-7-(piperazin-1-yl)-4H-pyrido
[1,2-a]pyrimidin-4-one
2-[3-fluoro-4-(2,2,2-trifluoroethoxy)phenyl]-7-(piperazin-
1-yl)-4H-pyrido[1,2-a]pyrimidin-4-one
2-(2-methyl-1,3-benzoxazol-5-yl)-7-(piperazin-1-yl)-4H-
pyrido[1,2-a]pyrimidin-4-one
2-(2-methyl-1,3-benzoxazol-5-yl)-7-[(3S)-3-methylpiper-
azin-1-yl]-4H-pyrido[1,2-a]pyrimidin-4-one
2-(3-fluoro-4-methylphenyl)-7-(piperazin-1-yl)-4H-pyrido
[1,2-a]pyrimidin-4-one
2-(3-fluoro-4-methylphenyl)-7-[(3S)-3-methylpiperazin-1-
yl]-4H-pyrido[1,2-a]pyrimidin-4-one
7-[(3S)-3-aminopyrrolidin-1-yl]-2-(3,4-dimethoxyphenyl)-
4H-pyrido[1,2-a]pyrimidin-4-one
2-(3,4-dimethoxyphenyl)-9-methyl-7-(piperazin-1-yl)-4H-
pyrido[1,2-a]pyrimidin-4-one
7-(1,4-diazepan-1-yl)-2-(2-methyl-1,3-benzothiazol-5-yl)-
4H-pyrido[1,2-a]pyrimidin-4-one
7-[(3S)-3-methylpiperazin-1-yl]-2-(4-methyl-1,3-thiazol-2-
yl)-4H-pyrido[1,2-a]pyrimidin-4-one
2-(4-methyl-1,3-thiazol-2-yl)-7-(piperazin-1-yl)-4H-pyrido
[1,2-a]pyrimidin-4-one
2-(3,4-dimethoxyphenyl)-7-(1-methylpiperidin-4-yl)-4H-
pyrido[1,2-a]pyrimidin-4-one
2-(3,4-dimethoxyphenyl)-7-[(3S)-3-(propan-2-ylamino)pyr-
rolidin-1-yl]-4H-pyrido[1,2-a]pyrimidin-4-one
2-(3-fluoro-4-methoxyphenyl)-7-(4-methyl-1,4-diazepan-1-
yl)-4H-pyrido[1,2-a]pyrimidin-4-one
2-(4-methoxy-3-nitrophenyl)-7-(piperazin-1-yl)-4H-pyrido
[1,2-a]pyrimidin-4-one
2-[3-fluoro-4-(methylsulfanyl)phenyl]-7-(piperazin-1-yl)-
4H-pyrido[1,2-a]pyrimidin-4-one
7-(4-methyl-1,4-diazepan-1-yl)-2-(2-methylimidazo[1,2-a]
pyridin-6-yl)-4H-pyrido[1,2-a]pyrimidin-4-one
2-(4,6-dimethylpyrazolo[1,5-a]pyrazin-2-yl)-7-(4-meth-
ylpiperazin-1-yl)-4H-pyrido[1,2-a]pyrimidin-4-one
2-(2-methyl-1,3-benzoxazol-6-yl)-7-(4-methylpiperazin-1-
yl)-4H-pyrido[1,2-a]pyrimidin-4-one
7-[(3R,5S)-3,5-dimethylpiperazin-1-yl]-2-(2-methyl-1,3-
benzoxazol-6-yl)-4H-pyrido[1,2-a]pyrimidin-4-one
2-(5-fluoro-6-methoxypyridin-3-yl)-7-[(3S)-3-methylpiper-
azin-1-yl]-4H-pyrido[1,2-a]pyrimidin-4-one
7-[(3R,5S)-3,5-dimethylpiperazin-1-yl]-2-(5-fluoro-6-
methoxypyridin-3-yl)-4H-pyrido[1,2-a]pyrimidin-4-one
7-[(3R,5S)-3,5-dimethylpiperazin-1-yl]-2-(2-methyl-1,3-
benzothiazol-5-yl)-4H-pyrido[1,2-a]pyrimidin-4-one
2-(2-methyl-1,3-benzothiazol-5-yl)-7-(4-methylpiperazin-
1-yl)-4H-pyrido[1,2-a]pyrimidin-4-one
2-(2-methyl-1,3-benzothiazol-5-yl)-7-(4-methyl-1,4-diaz-
epan-1-yl)-4H-pyrido[1,2-a]pyrimidin-4-one
7-[(8aS)-hexahydropyrrolo[1,2-a]pyrazin-2(1H)-yl]-2-(2-
methyl-1,3-benzothiazol-5-yl)-4H-pyrido[1,2-a]pyrimi-
din-4-one
2-(4-methyl-1H-imidazol-1-yl)-7-(piperazin-1-yl)-4H-
pyrido[1,2-a]pyrimidin-4-one
2-(4-methyl-1H-imidazol-1-yl)-7-[(3S)-3-methylpiperazin-
1-yl]-4H-pyrido[1,2-a]pyrimidin-4-one
2-(3,4-dimethoxyphenyl)-7-{[2-(methylamino)ethyl]
amino}-4H-pyrido[1,2-a]pyrimidin-4-one
2-(5-fluoro-6-methoxypyridin-3-yl)-7-(piperazin-1-yl)-4H-
pyrido[1,2-a]pyrimidin-4-one
2-(3,5-difluoro-4-methoxyphenyl)-7-(piperazin-1-yl)-4H-
pyrido[1,2-a]pyrimidin-4-one
2-(3,5-difluoro-4-methoxyphenyl)-7-[(3S)-3-methylpiper-
azin-1-yl]-4H-pyrido[1,2-a]pyrimidin-4-one
7-[4-(dimethylamino)piperidin-1-yl]-2-(3-fluoro-4-
methoxyphenyl)-4H-pyrido[1,2-a]pyrimidin-4-one
2-(3-fluoro-4-methoxyphenyl)-7-(1,2,3,6-tetrahydropyri-
din-4-yl)-4H-pyrido[1,2-a]pyrimidin-4-one
2-(3,4-dimethoxyphenyl)-7-(piperidin-4-ylamino)-4H-
pyrido[1,2-a]pyrimidin-4-one 2-(3,4-dimethoxyphenyl)-7-(1-methyl-1,2,3,6-tetrahydro-pyridin-4-yl)-4H-pyrido[1,2-a]pyrimidin-4-one
2-(3-chloro-5-fluorophenyl)-7-[(3S)-3-methylpiperazin-1-yl]-4H-pyrido[1,2-a]pyrimidin-4-one
2-(3-chloro-5-fluorophenyl)-7-(piperazin-1-yl)-4H-pyrido[1,2-a]pyrimidin-4-one
7-[(3S)-3-methylpiperazin-1-yl]-2-(1-methyl-1H-pyrazol-4-yl)-4H-pyrido[1,2-a]pyrimidin-4-one
2-(1-methyl-1H-pyrazol-4-yl)-7-(piperazin-1-yl)-4H-pyrido[1,2-a]pyrimidin-4-one
2-(2-methyl-1,3-benzoxazol-6-yl)-7-[(3R)-3-methylpiperazin-1-yl]-4H-pyrido[1,2-a]pyrimidin-4-one
7-(3,3-dimethylpiperazin-1-yl)-2-(2-methyl-1,3-benzoxazol-6-yl)-4H-pyrido[1,2-a]pyrimidin-4-one
7-(1,4-diazepan-1-yl)-2-(2-methyl-1,3-benzoxazol-6-yl)-4H-pyrido[1,2-a]pyrimidin-4-one
2-(2-methyl-1,3-benzoxazol-6-yl)-7-(4-methyl-1,4-diazepan-1-yl)-4H-pyrido[1,2-a]pyrimidin-4-one
7-[(8aS)-hexahydropyrrolo[1,2-a]pyrazin-2(1H)-yl]-2-(2-methyl-1,3-benzoxazol-6-yl)-4H-pyrido[1,2-a]pyrimidin-4-one
7-[(8aR)-hexahydropyrrolo[1,2-a]pyrazin-2(1H)-yl]-2-(2-methyl-1,3-benzoxazol-6-yl)-4H-pyrido[1,2-a]pyrimidin-4-one
2-(4,5-dimethoxypyridin-2-yl)-7-(piperazin-1-yl)-4H-pyrido[1,2-a]pyrimidin-4-one
7-[3-(dimethylamino)pyrrolidin-1-yl]-2-(3-fluoro-4-methoxyphenyl)-4H-quinolizin-4-one
7-(4-aminopiperidin-1-yl)-2-(3-fluoro-4-methoxyphenyl)-4H-quinolizin-4-one
7-(4-ethylpiperazin-1-yl)-2-(2-methyl-1,3-benzoxazol-6-yl)-4H-pyrido[1,2-a]pyrimidin-4-one
7-[4-(dimethylamino)piperidin-1-yl]-2-(3-fluoro-4-methoxyphenyl)-4H-quinolizin-4-one
2-(3-fluoro-4-methoxyphenyl)-7-(1-methyl-1,2,3,6-tetrahydropyridin-4-yl)-4H-pyrido[1,2-a]pyrimidin-4-one
7-[(3S)-3-(dimethylamino)pyrrolidin-1-yl]-2-(3-fluoro-4-methoxyphenyl)-4H-pyrido[1,2-a]pyrimidin-4-one
7-[(3R,4R)-3-(dimethylamino)-4-hydroxypyrrolidin-1-yl]-2-(3-fluoro-4-methoxyphenyl)-4H-pyrido[1,2-a]pyrimidin-4-one
7-(4-aminopiperidin-1-yl)-2-(3-fluoro-4-methoxyphenyl)-4H-pyrido[1,2-a]pyrimidin-4-one
2-(3-fluoro-4-methoxyphenyl)-7-[4-(methylamino)piperidin-1-yl]-4H-pyrido[1,2-a]pyrimidin-4-one
2-(8-fluoro-2-methylimidazo[1,2-a]pyridin-6-yl)-7-(piperazin-1-yl)-4H-pyrido[1,2-a]pyrimidin-4-one
7-[(3R,5S)-3,5-dimethylpiperazin-1-yl]-2-(8-fluoro-2-methylimidazo[1,2-a]pyridin-6-yl)-4H-pyrido[1,2-a]pyrimidin-4-one
2-(8-fluoro-2-methylimidazo[1,2-a]pyridin-6-yl)-7-(4-methyl-1,4-diazepan-1-yl)-4H-pyrido[1,2-a]pyrimidin-4-one
2-(3-fluoro-4-methoxyphenyl)-7-[(3aR,6aS)-hexahydropyrrolo[3,4-c]pyrrol-2(1H)-yl]-4H-pyrido[1,2-a]pyrimidin-4-one
2-(3-fluoro-4-methoxyphenyl)-7-[(3aR,6aS)-5-methylhexahydropyrrolo[3,4-c]pyrrol-2(1H)-yl]-4H-pyrido[1,2-a]pyrimidin-4-one
2-(3,4-dimethoxyphenyl)-7-[1-(2-hydroxyethyl)piperidin-4-yl]-4H-pyrido[1,2-a]pyrimidin-4-one
2-(4-fluoro-3-methoxyphenyl)-7-[(3S)-3-methylpiperazin-1-yl]-4H-pyrido[1,2-a]pyrimidin-4-one
2-(4-fluoro-3-methoxyphenyl)-7-(piperazin-1-yl)-4H-pyrido[1,2-a]pyrimidin-4-one
2-(3,4-difluoro-5-methoxyphenyl)-7-[(3S)-3-methylpiperazin-1-yl]-4H-pyrido[1,2-a]pyrimidin-4-one
2-(3,4-difluoro-5-methoxyphenyl)-7-(piperazin-1-yl)-4H-pyrido[1,2-a]pyrimidin-4-one
2-(2-methyl-1,3-benzothiazol-6-yl)-7-(piperazin-1-yl)-4H-pyrido[1,2-a]pyrimidin-4-one
7-(3-fluoro-4-methoxyphenyl)-2-(piperazin-1-yl)-4H-pyrido[1,2-a]pyrimidin-4-one
2-(2-methyl-1,3-benzothiazol-6-yl)-7-[(3S)-3-methylpiperazin-1-yl]-4H-pyrido[1,2-a]pyrimidin-4-one
2-(3-fluoro-4-methoxyphenyl)-7-[(3S)-3-(methylamino)pyrrolidin-1-yl]-4H-pyrido[1,2-a]a]pyrimidin-4-one
2-(3-fluoro-4-methoxyphenyl)-7-{4-[(methylamino)methyl]piperidin-1-yl}-4H-pyrido[1,2-a]pyrimidin-4-one
7-[(3S)-3-aminopyrrolidin-1-yl]-2-(3-fluoro-4-methoxyphenyl)-4H-pyrido[1,2-a]pyrimidin-4-one
2-(3-fluoro-4-methoxyphenyl)-7-{[(3R)-1-methylpyrrolidin-3-yl]amino}-4H-pyrido[1,2-a]pyrimidin-4-one
7-{4-[(dimethylamino)methyl]piperidin-1-yl}-2-(3-fluoro-4-methoxyphenyl)-4H-pyrido[1,2-a]pyrimidin-4-one
2-(6-methoxypyridin-2-yl)-7-(piperazin-1-yl)-4H-pyrido[1,2-a]pyrimidin-4-one
7-(piperazin-1-yl)-2-(pyridin-3-yl)-4H-pyrido[1,2-a]pyrimidin-4-one
2-(5-methoxypyridin-3-yl)-7-(piperazin-1-yl)-4H-pyrido[1,2-a]pyrimidin-4-one
3-fluoro-5-{7-[(3S)-3-methylpiperazin-1-yl]-4-oxo-4H-pyrido[1,2-a]pyrimidin-2-yl}benzonitrile
3-fluoro-5-[4-oxo-7-(piperazin-1-yl)-4H-pyrido[1,2-a]pyrimidin-2-yl]benzonitrile
2-(3-fluoro-4-methoxyphenyl)-7-[(3'S,4'S)-4'-hydroxy-1,3'-bipyrrolidin-1'-yl]-4H-pyrido[1,2-a]pyrimidin-4-one
2-(3-fluoro-4-methoxyphenyl)-7-{methyl[(3R)-pyrrolidin-3-yl]amino}-4H-pyrido[1,2-a]pyrimidin-4-one
7-[(3S)-3,4-dimethylpiperazin-1-yl]-2-(2-methyl-1,3-benzoxazol-6-yl)-4H-pyrido[1,2-a]pyrimidin-4-one
2-(3,4-dimethoxyphenyl)-7-[(1-methylpiperidin-4-yl)oxy]-4H-pyrido[1,2-a]pyrimidin-4-one
2-(3,4-dimethoxyphenyl)-7-[(3S)-pyrrolidin-3-yloxy]-4H-pyrido[1,2-a]pyrimidin-4-one
2-(3,4-dimethoxyphenyl)-7-(piperidin-4-yloxy)-4H-pyrido[1,2-a]pyrimidin-4-one
7-(1,4-diazepan-1-yl)-2-(3,4-dimethoxyphenyl)-9-methyl-4H-pyrido[1,2-a]pyrimidin-4-one
2-(3-fluoro-4-methoxyphenyl)-7-{methyl[(3R)-1-methylpyrrolidin-3-yl]amino}-4H-pyrido[1,2-a]pyrimidin-4-one
7-[4-(dimethylamino)piperidin-1-yl]-2-(2-methyl-1,3-benzoxazol-6-yl)-4H-pyrido[1,2-a]pyrimidin-4-one
7-[(3S)-3-(dimethylamino)pyrrolidin-1-yl]-2-(2-methyl-1,3-benzoxazol-6-yl)-4H-pyrido[1,2-a]pyrimidin-4-one
7-(4-aminopiperidin-1-yl)-2-(2-methyl-1,3-benzoxazol-6-yl)-4H-pyrido[1,2-a]pyrimidin-4-one
7-[(3aR,6aS)-hexahydropyrrolo[3,4-c]pyrrol-2(1H)-yl]-2-(2-methyl-1,3-benzoxazol-6-yl)-4H-pyrido[1,2-a]pyrimidin-4-one
7-[(3R)-3,4-dimethylpiperazin-1-yl]-2-(2-methyl-1,3-benzoxazol-6-yl)-4H-pyrido[1,2-a]pyrimidin-4-one
2-(3,4-dimethoxyphenyl)-7-(1,2,3,6-tetrahydropyridin-4-yl)-4H-quinolizin-4-one
2-(3-fluoro-4-methoxyphenyl)-7-[(3aR,6aR)-1-methylhexahydropyrrolo[3,4-b]pyrrol-5(1H)-yl]-4H-pyrido[1,2-a]pyrimidin-4-one
2-(3,4-dimethoxyphenyl)-9-methyl-7-(1,2,3,6-tetrahydropyridin-4-yl)-4H-pyrido[1,2-a]pyrimidin-4-one
2-(3,4-dimethoxyphenyl)-7-[1-(2-hydroxyethyl)-1,2,3,6-tetrahydropyridin-4-yl]-4H-pyrido[1,2-a]pyrimidin-4-one
2-(3,4-dimethoxyphenyl)-7-(1-methyl-1,2,3,6-tetrahydropyridin-4-yl)-4H-quinolizin-4-one

- 2-(3,4-dimethoxyphenyl)-9-methyl-7-(piperidin-4-yl)-4H-pyrido[1,2-a]pyrimidin-4-one
- 2-(3,4-dimethoxyphenyl)-9-methyl-7-(1-methyl-1,2,3,6-tetrahydropyridin-4-yl)-4H-pyrido[1,2-a]pyrimidin-4-one
- 2-(3,4-dimethoxyphenyl)-9-methyl-7-(1-methylpiperidin-4-yl)-4H-pyrido[1,2-a]pyrimidin-4-one
- 7-(1,4-diazepan-1-yl)-2-(2-methyl-1,3-benzothiazol-6-yl)-4H-pyrido[1,2-a]pyrimidin-4-one
- 2-(2-methyl-1,3-benzothiazol-6-yl)-7-(4-methyl-1,4-diazepan-1-yl)-4H-pyrido[1,2-a]pyrimidin-4-one
- 7-[(8aS)-hexahydropyrrolo[1,2-a]pyrazin-2(1H)-yl]-2-(2-methyl-1,3-benzothiazol-6-yl)-4H-pyrido[1,2-a]pyrimidin-4-one
- 2-(2-methyl-1,3-benzothiazol-6-yl)-7-(4-methylpiperazin-1-yl)-4H-pyrido[1,2-a]pyrimidin-4-one
- 2-(3,4-dimethoxyphenyl)-7-[(3aR,6aS)-hexahydropyrrolo[3,4-c]pyrrol-2(1H)-yl]-9-methyl-4H-pyrido[1,2-a]pyrimidin-4-one
- 7-[(3S)-3,4-dimethylpiperazin-1-yl]-2-(4,6-dimethylpyrazolo[1,5-a]pyrazin-2-yl)-4H-pyrido[1,2-a]pyrimidin-4-one
- 2-(4,6-dimethylpyrazolo[1,5-a]pyrazin-2-yl)-7-[(3R,5S)-3,4,5-trimethylpiperazin-1-yl]-4H-pyrido[1,2-a]pyrimidin-4-one
- 2-(3,4-dimethoxyphenyl)-9-methyl-7-[(3aR,6aS)-5-methylhexahydropyrrolo[3,4-c]pyrrol-2(1H)-yl]-4H-pyrido[1,2-a]pyrimidin-4-one
- 2-(3,4-dimethoxyphenyl)-7-[4-(dimethylamino)piperidin-1-yl]-9-methyl-4H-pyrido[1,2-a]pyrimidin-4-one
- 7-[(1R,5S)-8-azabicyclo[3.2.1]oct-2-en-3-yl]-2-(3,4-dimethoxyphenyl)-4H-pyrido[1,2-a]pyrimidin-4-one
- 2-(3,4-dimethoxyphenyl)-7-(1,2,5,6-tetrahydropyridin-3-yl)-4H-pyrido[1,2-a]pyrimidin-4-one
- 7-[(3R)-3-(dimethylamino)pyrrolidin-1-yl]-2-(2-methyl-1,3-benzoxazol-6-yl)-4H-pyrido[1,2-a]pyrimidin-4-one
- 2-(2-ethyl-1,3-benzoxazol-6-yl)-7-(piperazin-1-yl)-4H-pyrido[1,2-a]pyrimidin-4-one
- 2-(2-ethyl-1,3-benzoxazol-6-yl)-7-[(3S)-3-methylpiperazin-1-yl]-4H-pyrido[1,2-a]pyrimidin-4-one
- 2-(2-methyl-1,3-benzoxazol-6-yl)-7-[(3aR,6aS)-5-methylhexahydropyrrolo[3,4-c]pyrrol-2(1H)-yl]-4H-pyrido[1,2-a]pyrimidin-4-one
- 7-(8-fluoro-2-methylimidazo[1,2-a]pyridin-6-yl)-2-(piperazin-1-yl)-4H-pyrido[1,2-a]pyrimidin-4-one
- 2-(8-fluoro-2-methylimidazo[1,2-a]pyridin-6-yl)-7-(4-methylpiperazin-1-yl)-4H-pyrido[1,2-a]pyrimidin-4-one
- 2-(8-fluoro-2-methylimidazo[1,2-a]pyridin-6-yl)-7-[(3R)-3-methylpiperazin-1-yl]-4H-pyrido[1,2-a]pyrimidin-4-one
- 2-(8-fluoro-2-methylimidazo[1,2-a]pyridin-6-yl)-7-[(8aS)-hexahydropyrrolo[1,2-a]pyrazin-2(1H)-yl]-4H-pyrido[1,2-a]pyrimidin-4-one
- 2-(8-fluoro-2-methylimidazo[1,2-a]pyridin-6-yl)-7-[(8aR)-hexahydropyrrolo[1,2-a]pyrazin-2(1H)-yl]-4H-pyrido[1,2-a]pyrimidin-4-one
- 7-(4-aminopiperidin-1-yl)-2-(8-fluoro-2-methylimidazo[1,2-a]pyridin-6-yl)-4H-pyrido[1,2-a]pyrimidin-4-one
- 7-[(3R)-3-(dimethylamino)pyrrolidin-1-yl]-2-(8-fluoro-2-methylimidazo[1,2-a]pyridin-6-yl)-4H-pyrido[1,2-a]pyrimidin-4-one
- 7-[(3S)-3-(dimethylamino)pyrrolidin-1-yl]-2-(8-fluoro-2-methylimidazo[1,2-a]pyridin-6-yl)-4H-pyrido[1,2-a]pyrimidin-4-one
- 2-(4-aminopiperidin-1-yl)-7-(3-fluoro-4-methoxyphenyl)-4H-pyrido[1,2-a]pyrimidin-4-one
- 2-[(3R)-3-(dimethylamino)pyrrolidin-1-yl]-7-(3-fluoro-4-methoxyphenyl)-4H-pyrido[1,2-a]pyrimidin-4-one
- 2-[(3S)-3-(dimethylamino)pyrrolidin-1-yl]-7-(3-fluoro-4-methoxyphenyl)-4H-pyrido[1,2-a]pyrimidin-4-one
- 2-(3-fluoro-4-methoxyphenyl)-7-[(3aR,6aS)-5-(2-hydroxyethyl)hexahydropyrrolo[3,4-c]pyrrol-2(1H)-yl]-4H-pyrido[1,2-a]pyrimidin-4-one
- 2-(3-fluoro-4-methoxyphenyl)-7-[(3aS,6aS)-1-methylhexahydropyrrolo[3,4-b]pyrrol-5(1H)-yl]-4H-pyrido[1,2-a]pyrimidin-4-one
- 2-(3-fluoro-4-methoxyphenyl)-7-[(3aR,6aS)-5-(propan-2-yl)hexahydropyrrolo[3,4-c]pyrrol-2(1H)-yl]-4H-pyrido[1,2-a]pyrimidin-4-one
- 7-[(3R)-3-(dimethylamino)pyrrolidin-1-yl]-2-(3-fluoro-4-methoxyphenyl)-4H-pyrido[1,2-a]pyrimidin-4-one
- 7-(3,3-dimethylpiperazin-1-yl)-2-(2-methyl-1,3-benzothiazol-6-yl)-4H-pyrido[1,2-a]pyrimidin-4-one
- 7-[(8aR)-hexahydropyrrolo[1,2-a]pyrazin-2(1H)-yl]-2-(2-methyl-1,3-benzothiazol-6-yl)-4H-pyrido[1,2-a]pyrimidin-4-one
- 7-[4-(dimethylamino)piperidin-1-yl]-2-(2-methyl-1,3-benzothiazol-6-yl)-4H-pyrido[1,2-a]pyrimidin-4-one
- 2-(2-methyl-1,3-benzothiazol-6-yl)-7-(piperidin-4-yloxy)-4H-pyrido[1,2-a]pyrimidin-4-one
- 2-(8-chloro-2-methylimidazo[1,2-a]pyridin-6-yl)-7-(piperazin-1-yl)-4H-pyrido[1,2-a]pyrimidin-4-one
- 2-(8-chloro-2-methylimidazo[1,2-a]pyridin-6-yl)-7-[(3R,5S)-3,5-dimethylpiperazin-1-yl]-4H-pyrido[1,2-a]pyrimidin-4-one
- 2-(8-chloro-2-methylimidazo[1,2-a]pyridin-6-yl)-7-(4-methyl-1,4-diazepan-1-yl)-4H-pyrido[1,2-a]pyrimidin-4-one
- 2-(8-chloro-2-methylimidazo[1,2-a]pyridin-6-yl)-7-[(3R)-3-methylpiperazin-1-yl]-4H-pyrido[1,2-a]pyrimidin-4-one
- 2-(8-chloro-2-methylimidazo[1,2-a]pyridin-6-yl)-7-[(3S)-3-methylpiperazin-1-yl]-4H-pyrido[1,2-a]pyrimidin-4-one
- 2-(8-chloro-2-methylimidazo[1,2-a]pyridin-6-yl)-7-[(8aR)-hexahydropyrrolo[1,2-a]pyrazin-2(1H)-yl]-4H-pyrido[1,2-a]pyrimidin-4-one
- 2-(8-chloro-2-methylimidazo[1,2-a]pyridin-6-yl)-7-[(8aS)-hexahydropyrrolo[1,2-a]pyrazin-2(1H)-yl]-4H-pyrido[1,2-a]pyrimidin-4-one
- 7-(3-fluoro-4-methoxyphenyl)-2-(1,2,3,6-tetrahydropyridin-4-yl)-4H-pyrido[1,2-a]pyrimidin-4-one
- 7-[(3S)-3,4-dimethylpiperazin-1-yl]-2-(8-fluoro-2-methylimidazo[1,2-a]pyridin-6-yl)-4H-pyrido[1,2-a]pyrimidin-4-one
- 7-[(3R)-3,4-dimethylpiperazin-1-yl]-2-(8-fluoro-2-methylimidazo[1,2-a]pyridin-6-yl)-4H-pyrido[1,2-a]pyrimidin-4-one
- 7-[4-(dimethylamino)piperidin-1-yl]-2-(8-fluoro-2-methylimidazo[1,2-a]pyridin-6-yl)-4H-pyrido[1,2-a]pyrimidin-4-one
- 2-[4-(dimethylamino)piperidin-1-yl]-7-(3-fluoro-4-methoxyphenyl)-4H-pyrido[1,2-a]pyrimidin-4-one
- 2-(4-fluoro-2-methyl-1,3-benzoxazol-6-yl)-7-(1,2,3,6-tetrahydropyridin-4-yl)-4H-pyrido[1,2-a]pyrimidin-4-one
- 2-(4-fluoro-2-methyl-1,3-benzoxazol-6-yl)-7-(1-methyl-1,2,3,6-tetrahydropyridin-4-yl)-4H-pyrido[1,2-a]pyrimidin-4-one
- 2-(3-fluoro-4-methoxyphenyl)-7-[(4aR,7aR)-octahydro-6H-pyrrolo[3,4-b]pyridin-6-yl]-4H-pyrido[1,2-a]pyrimidin-4-one
- 2-(2-methyl-1,3-benzoxazol-6-yl)-7-(1,2,3,6-tetrahydropyridin-4-yl)-4H-pyrido[1,2-a]pyrimidin-4-one
- 2-(2-methyl-1,3-benzoxazol-6-yl)-7-(1-methyl-1,2,3,6-tetrahydropyridin-4-yl)-4H-pyrido[1,2-a]pyrimidin-4-one 7-(1-ethyl-1,2,3,6-tetrahydropyridin-4-yl)-2-(2-methyl-1,3-benzoxazol-6-yl)-4H-pyrido[1,2-a]pyrimidin-4-one
2-(4-fluoro-2-methyl-1,3-benzoxazol-6-yl)-7-(piperazin-1-yl)-4H-pyrido[1,2-a]pyrimidin-4-one
2-(4-fluoro-2-methyl-1,3-benzoxazol-6-yl)-7-[(3S)-3-methylpiperazin-1-yl]-4H-pyrido[1,2-a]pyrimidin-4-one
7-[(3S)-3,4-dimethylpiperazin-1-yl]-2-(4-fluoro-2-methyl-1,3-benzoxazol-6-yl)-4H-pyrido[1,2-a]pyrimidin-4-one
2-(4-fluoro-2-methyl-1,3-benzoxazol-6-yl)-7-(4-methylpiperazin-1-yl)-4H-pyrido[1,2-a]pyrimidin-4-one
7-(4-ethylpiperazin-1-yl)-2-(4-fluoro-2-methyl-1,3-benzoxazol-6-yl)-4H-pyrido[1,2-a]pyrimidin-4-one
2-(4-fluoro-2-methyl-1,3-benzoxazol-6-yl)-7-(4-propylpiperazin-1-yl)-4H-pyrido[1,2-a]pyrimidin-4-one
7-[(3aR,6aS)-5-ethylhexahydropyrrolo[3,4-c]pyrrol-2(1H)-yl]-2-(3-fluoro-4-methoxyphenyl)-4H-pyrido[1,2-a]pyrimidin-4-one
2-(3-fluoro-4-methoxyphenyl)-9-methyl-7-(1,2,3,6-tetrahydropyridin-4-yl)-4H-pyrido[1,2-a]pyrimidin-4-one
2-(3-fluoro-4-methoxyphenyl)-7-[(4aR,7aR)-1-methyloctahydro-6H-pyrrolo[3,4-b]pyridin-6-yl]-4H-pyrido[1,2-a]pyrimidin-4-one
2-(3,4-dimethoxyphenyl)-9-methyl-7-[(3R)-3-methylpiperazin-1-yl]-4H-pyrido[1,2-a]pyrimidin-4-one
2-(3-fluoro-4-methoxyphenyl)-9-methyl-7-(1-methyl-1,2,3,6-tetrahydropyridin-4-yl)-4H-pyrido[1,2-a]pyrimidin-4-one
7-(3-fluoro-4-methoxyphenyl)-2-(piperidin-4-yl)-4H-pyrido[1,2-a]pyrimidin-4-one
7-(3-fluoro-4-methoxyphenyl)-2-(1-methylpiperidin-4-yl)-4H-pyrido[1,2-a]pyrimidin-4-one
7-(1-ethyl-1,2,3,6-tetrahydropyridin-4-yl)-2-(4-fluoro-2-methyl-1,3-benzoxazol-6-yl)-4H-pyrido[1,2-a]pyrimidin-4-one
2-(4-fluoro-2-methyl-1,3-benzoxazol-6-yl)-7-(1-propyl-1,2,3,6-tetrahydropyridin-4-yl)-4H-pyrido[1,2-a]pyrimidin-4-one
2-(3,4-dimethoxyphenyl)-7-[(1R,5S)-8-methyl-8-azabicyclo[3.2.1]oct-3-yl]-4H-pyrido[1,2-a]pyrimidin-4-one
2-(3,4-dimethoxyphenyl)-7-[(2R)-2-methylpiperazin-1-yl]-4H-pyrido[1,2-a]pyrimidin-4-one
2-(2-methyl-1,3-benzoxazol-6-yl)-7-[(3S)-3-methylpiperazin-1-yl]-4H-quinolizin-4-one
2-(2-methyl-1,3-benzoxazol-6-yl)-7-(4-methylpiperazin-1-yl)-4H-quinolizin-4-one
7-[(3S)-4-ethyl-3-methylpiperazin-1-yl]-2-(2-methyl-1,3-benzoxazol-6-yl)-4H-quinolizin-4-one
7-[(3S)-3,4-dimethylpiperazin-1-yl]-2-(2-methyl-1,3-benzoxazol-6-yl)-4H-quinolizin-4-one
7-(4-aminopiperidin-1-yl)-2-(2-methyl-1,3-benzoxazol-6-yl)-4H-quinolizin-4-one
2-(3-fluoro-4-methoxyphenyl)-9-methyl-7-[(3S)-3-methylpiperazin-1-yl]-4H-pyrido[1,2-a]pyrimidin-4-one
7-[4-(dimethylamino)piperidin-1-yl]-2-(3-fluoro-4-methoxyphenyl)-9-methyl-4H-pyrido[1,2-a]pyrimidin-4-one
2-(3-fluoro-4-methoxyphenyl)-9-methyl-7-(1-methylpiperidin-4-yl)-4H-pyrido[1,2-a]pyrimidin-4-one
7-[4-(cyclopropylamino)piperidin-1-yl]-2-(3,4-dimethoxyphenyl)-9-methyl-4H-pyrido[1,2-a]pyrimidin-4-one
2-(8-chloro-2-methylimidazo[1,2-a]pyridin-6-yl)-7-[(3S)-3,4-dimethylpiperazin-1-yl]-4H-pyrido[1,2-a]pyrimidin-4-one
2-(3,4-dimethoxyphenyl)-7-[(3R,5S)-3,5-dimethylpiperazin-1-yl]-9-methyl-4H-pyrido[1,2-a]pyrimidin-4-one
2-(3,4-dimethoxyphenyl)-7-[(3R)-3,4-dimethylpiperazin-1-yl]-9-methyl-4H-pyrido[1,2-a]pyrimidin-4-one 2-(4,6-dimethylpyrazolo[1,5-a]pyrazin-2-yl)-7-(4-methyl-1,4-diazepan-1-yl)-4H-pyrido[1,2-a]pyrimidin-4-one
2-(4,6-dimethylpyrazolo[1,5-a]pyrazin-2-yl)-7-[(3R)-3-methylpiperazin-1-yl]-4H-pyrido[1,2-a]pyrimidin-4-one
2-(4,6-dimethylpyrazolo[1,5-a]pyrazin-2-yl)-7-[(8aS)-hexahydropyrrolo[1,2-a]pyrazin-2(1H)-yl]-4H-pyrido[1,2-a]pyrimidin-4-one
2-(4,6-dimethylpyrazolo[1,5-a]pyrazin-2-yl)-7-[(8aR)-hexahydropyrrolo[1,2-a]pyrazin-2(1H)-yl]-4H-pyrido[1,2-a]pyrimidin-4-one
2-(4,6-dimethylpyrazolo[1,5-a]pyrazin-2-yl)-7-(4-ethylpiperazin-1-yl)-4H-pyrido[1,2-a]pyrimidin-4-one
7-[4-(dimethylamino)piperidin-1-yl]-2-(4,6-dimethylpyrazolo[1,5-a]pyrazin-2-yl)-4H-pyrido[1,2-a]pyrimidin-4-one
7-(3,3-dimethylpiperazin-1-yl)-2-(4,6-dimethylpyrazolo[1,5-a]pyrazin-2-yl)-4H-pyrido[1,2-a]pyrimidin-4-one
7-(4-cyclopropylpiperazin-1-yl)-2-(4,6-dimethylpyrazolo[1,5-a]pyrazin-2-yl)-4H-pyrido[1,2-a]pyrimidin-4-one
2-(4,6-dimethylpyrazolo[1,5-a]pyrazin-2-yl)-7-(1,2,3,6-tetrahydropyridin-4-yl)-4H-pyrido[1,2-a]pyrimidin-4-one
2-(4,6-dimethylpyrazolo[1,5-a]pyrazin-2-yl)-7-[(3R)-4-ethyl-3-methylpiperazin-1-yl]-4H-pyrido[1,2-a]pyrimidin-4-one
2-(3,4-dimethoxyphenyl)-9-methyl-7-(4-methylpiperazin-1-yl)-4H-pyrido[1,2-a]pyrimidin-4-one
2-(3,4-dimethoxyphenyl)-7-[4-(dimethylamino)piperidin-1-yl]-9-ethyl-4H-pyrido[1,2-a]pyrimidin-4-one
2-(3,4-dimethoxyphenyl)-7-[1-(2-hydroxyethyl)-1,2,3,6-tetrahydropyridin-4-yl]-9-methyl-4H-pyrido[1,2-a]pyrimidin-4-one
7-[4-(dimethylamino)piperidin-1-yl]-2-(2-methyl-1,3-benzothiazol-5-yl)-4H-pyrido[1,2-a]pyrimidin-4-one
7-(4-aminopiperidin-1-yl)-2-(2-methyl-1,3-benzothiazol-5-yl)-4H-pyrido[1,2-a]pyrimidin-4-one
7-[(3aR,6aS)-hexahydropyrrolo[3,4-c]pyrrol-2(1H)-yl]-2-(2-methyl-1,3-benzothiazol-5-yl)-4H-pyrido[1,2-a]pyrimidin-4-one
2-(4,6-dimethylpyrazolo[1,5-a]pyrazin-2-yl)-7-(1-methyl-1,2,3,6-tetrahydropyridin-4-yl)-4H-pyrido[1,2-a]pyrimidin-4-one
2-(4,6-dimethylpyrazolo[1,5-a]pyrazin-2-yl)-7-(1-ethyl-1,2,3,6-tetrahydropyridin-4-yl)-4H-pyrido[1,2-a]pyrimidin-4-one
2-(4,6-dimethylpyrazolo[1,5-a]pyrazin-2-yl)-7-(1-propyl-1,2,3,6-tetrahydropyridin-4-yl)-4H-pyrido[1,2-a]pyrimidin-4-one
2-(3,4-dimethoxyphenyl)-7-(1,2,3,6-tetrahydropyridin-4-yl)-4H-pyrimido[1,2-a]pyrimidin-4-one
7-(1-cyclopropyl-1,2,3,6-tetrahydropyridin-4-yl)-2-(4,6-dimethylpyrazolo[1,5-a]pyrazin-2-yl)-4H-pyrido[1,2-a]pyrimidin-4-one
2-(4,6-dimethylpyrazolo[1,5-a]pyrazin-2-yl)-7-[1-(propan-2-yl)-1,2,3,6-tetrahydropyridin-4-yl]-4H-pyrido[1,2-a]pyrimidin-4-one
7-(1-cyclobutyl-1,2,3,6-tetrahydropyridin-4-yl)-2-(4,6-dimethylpyrazolo[1,5-a]pyrazin-2-yl)-4H-pyrido[1,2-a]pyrimidin-4-one
2-(4,6-dimethylpyrazolo[1,5-a]pyrazin-2-yl)-7-[1-(oxetan-3-yl)-1,2,3,6-tetrahydropyridin-4-yl]-4H-pyrido[1,2-a]pyrimidin-4-one
2-(3,4-dimethoxyphenyl)-9-methyl-7-[4-(methylamino)piperidin-1-yl]-4H-pyrido[1,2-a]pyrimidin-4-one
2-(3,4-dimethoxyphenyl)-7-[4-(ethylamino)piperidin-1-yl]-9-methyl-4H-pyrido[1,2-a]pyrimidin-4-one
2-(3,4-dimethoxyphenyl)-8-methyl-7-(piperazin-1-yl)-4H-pyrido[1,2-a]pyrimidin-4-one 2-(3,4-dimethoxyphenyl)-7-[4-(propan-2-ylamino)piperidin-1-yl]-4H-pyrido[1,2-a]pyrimidin-4-one
7-(1-cyclobutyl-1,2,3,6-tetrahydropyridin-4-yl)-2-(3,4-dimethoxyphenyl)-4H-pyrido[1,2-a]pyrimidin-4-one
2-(3,4-dimethoxyphenyl)-7-[1-(propan-2-yl)-1,2,3,6-tetrahydropyridin-4-yl]-4H-pyrido[1,2-a]pyrimidin-4-one
2-(3,4-dimethoxyphenyl)-7-[1-(oxetan-3-yl)-1,2,3,6-tetrahydropyridin-4-yl]-4H-pyrido[1,2-a]pyrimidin-4-one
2-(3,4-dimethoxyphenyl)-7-(1-propyl-1,2,3,6-tetrahydropyridin-4-yl)-4H-pyrido[1,2-a]pyrimidin-4-one
2-(3,4-dimethoxyphenyl)-7-[4-(methylamino)cyclohex-1-en-1-yl]-4H-pyrido[1,2-a]pyrimidin-4-one
2-(3,4-dimethoxyphenyl)-7-[4-(dimethylamino)cyclohex-1-en-1-yl]-4H-pyrido[1,2-a]pyrimidin-4-one
2-(3,4-dimethoxyphenyl)-7-{4-[ethyl(methyl)amino]cyclohex-1-en-1-yl}-4H-pyrido[1,2-a]pyrimidin-4-one
2-(3,4-dimethoxyphenyl)-7-{4-[methyl(propyl)amino]cyclohex-1-en-1-yl}-4H-pyrido[1,2-a]pyrimidin-4-one
2-(3,4-dimethoxyphenyl)-7-(1-ethyl-1,2,3,6-tetrahydropyridin-4-yl)-4H-pyrido[1,2-a]pyrimidin-4-one
7-(3,4-dimethoxyphenyl)-2-(1,2,3,6-tetrahydropyridin-4-yl)-4H-pyrido[1,2-a]pyrimidin-4-one
7-(8-fluoro-2-methylimidazo[1,2-a]pyridin-6-yl)-2-(1,2,3,6-tetrahydropyridin-4-yl)-4H-pyrido[1,2-a]pyrimidin-4-one
2-(8-fluoro-2-methylimidazo[1,2-a]pyridin-6-yl)-7-[4-(propan-2-yl)piperazin-1-yl]-4H-pyrido[1,2-a]pyrimidin-4-one
2-(8-chloro-2-methylimidazo[1,2-a]pyridin-6-yl)-7-[4-(propan-2-yl)piperazin-1-yl]-4H-pyrido[1,2-a]pyrimidin-4-one
7-(2-methylimidazo[1,2-a]pyridin-6-yl)-2-(1,2,3,6-tetrahydropyridin-4-yl)-4H-pyrido[1,2-a]pyrimidin-4-one
7-(2-methylimidazo[1,2-a]pyridin-6-yl)-2-(1-methyl-1,2,3,6-tetrahydropyridin-4-yl)-4H-pyrido[1,2-a]pyrimidin-4-one
7-(3,4-dimethoxyphenyl)-2-(1-methyl-1,2,3,6-tetrahydropyridin-4-yl)-4H-pyrido[1,2-a]pyrimidin-4-one
2-(3,4-dimethoxyphenyl)-9-methyl-7-(1-propyl-1,2,3,6-tetrahydropyridin-4-yl)-4H-pyrido[1,2-a]pyrimidin-4-one
7-(1-cyclobutyl-1,2,3,6-tetrahydropyridin-4-yl)-2-(3,4-dimethoxyphenyl)-9-methyl-4H-pyrido[1,2-a]pyrimidin-4-one
2-(2-methyl-1,3-benzothiazol-6-yl)-7-(piperidin-4-yl)-4H-pyrimido[1,2-b]pyridazin-4-one
7-(4-aminopiperidin-1-yl)-2-(2-methyl-1,3-benzothiazol-6-yl)-4H-pyrido[1,2-a]pyrimidin-4-one
7-(3-aminopyrrolidin-1-yl)-2-(2-methyl-1,3-benzothiazol-6-yl)-4H-pyrido[1,2-a]pyrimidin-4-one
7-[(3R)-3-(dimethylamino)pyrrolidin-1-yl]-2-(2-methyl-1,3-benzothiazol-6-yl)-4H-pyrido[1,2-a]pyrimidin-4-one
2-(2-methyl-1,3-benzothiazol-6-yl)-7-(1,2,3,6-tetrahydropyridin-4-yl)-4H-pyrido[1,2-a]pyrimidin-4-one
2-(8-fluoro-2-methylimidazo[1,2-a]pyridin-6-yl)-7-[4-(2-methoxyethyl)piperazin-1-yl]-4H-pyrido[1,2-a]pyrimidin-4-one
2-(3,4-dimethoxyphenyl)-9-methyl-7-[1-(oxetan-3-yl)-1,2,3,6-tetrahydropyridin-4-yl]-4H-pyrido[1,2-a]pyrimidin-4-one
2-(3,4-dimethoxyphenyl)-9-methyl-7-[1-(propan-2-yl)-1,2,3,6-tetrahydropyridin-4-yl]-4H-pyrido[1,2-a]pyrimidin-4-one
2-(3,4-dimethoxyphenyl)-7-(1-ethyl-1,2,3,6-tetrahydropyridin-4-yl)-9-methyl-4H-pyrido[1,2-a]pyrimidin-4-one
2-(3,4-dimethoxyphenyl)-8-methyl-7-(1,2,3,6-tetrahydropyridin-4-yl)-4H-pyrido[1,2-a]pyrimidin-4-one
7-(1-cyclopropyl-1,2,3,6-tetrahydropyridin-4-yl)-2-(3,4-dimethoxyphenyl)-9-methyl-4H-pyrido[1,2-a]pyrimidin-4-one
2-(3,4-dimethoxyphenyl)-8-methyl-7-(1-methyl-1,2,3,6-tetrahydropyridin-4-yl)-4H-pyrido[1,2-a]pyrimidin-4-one
2-(2-methyl-1,3-benzothiazol-6-yl)-7-(1-methyl-1,2,3,6-tetrahydropyridin-4-yl)-4H-pyrido[1,2-a]pyrimidin-4-one
7-[1-(2-hydroxyethyl)-1,2,3,6-tetrahydropyridin-4-yl]-2-(2-methyl-1,3-benzothiazol-6-yl)-4H-pyrido[1,2-a]pyrimidin-4-one
2-(2-methyl-1,3-benzothiazol-6-yl)-7-[1-(propan-2-yl)-1,2,3,6-tetrahydropyridin-4-yl]-4H-pyrido[1,2-a]pyrimidin-4-one
7-(1-cyclopropyl-1,2,3,6-tetrahydropyridin-4-yl)-2-(2-methyl-1,3-benzothiazol-6-yl)-4H-pyrido[1,2-a]pyrimidin-4-one
7-(1-ethyl-1,2,3,6-tetrahydropyridin-4-yl)-2-(2-methyl-1,3-benzothiazol-6-yl)-4H-pyrido[1,2-a]pyrimidin-4-one
7-[(3R)-3,4-dimethylpiperazin-1-yl]-2-(4,6-dimethylpyrazolo[1,5-a]pyrazin-2-yl)-4H-pyrido[1,2-a]pyrimidin-4-one
2-(3,4-dimethoxyphenyl)-7-(1,2,3,6-tetrahydropyridin-4-yl)-4H-pyrimido[1,2-b]pyridazin-4-one
7-[(1S,4S)-2,5-diazabicyclo[2.2.1]hept-2-yl]-2-(4,6-dimethylpyrazolo[1,5-a]pyrazin-2-yl)-4H-pyrido[1,2-a]pyrimidin-4-one
2-(4,6-dimethylpyrazolo[1,5-a]pyrazin-2-yl)-7-[(1S,4S)-5-methyl-2,5-diazabicyclo[2.2.1]hept-2-yl]-4H-pyrido[1,2-a]pyrimidin-4-one
2-(4,6-dimethylpyrazolo[1,5-a]pyrazin-2-yl)-7-[(1S,4S)-5-ethyl-2,5-diazabicyclo[2.2.1]hept-2-yl]-4H-pyrido[1,2-a]pyrimidin-4-one
2-(3,4-dimethoxyphenyl)-7-(1,2,3,6-tetrahydropyridin-4-yl)-4H-pyrazino[1,2-a]pyrimidin-4-one
2-(3-fluoro-4-methoxyphenyl)-7-(piperidin-4-yl)-4H-pyrido[1,2-a]pyrimidin-4-one
2-(3,4-dimethoxyphenyl)-7-(1-ethylpiperidin-4-yl)-4H-pyrido[1,2-a]pyrimidin-4-one
2-(3,4-dimethoxyphenyl)-7-[cis-4-(methylamino)cyclohexyl]-4H-pyrido[1,2-a]pyrimidin-4-one
2-(3,4-dimethoxyphenyl)-7-(piperidin-3-yl)-4H-pyrido[1,2-a]pyrimidin-4-one
2-(3,4-dimethoxyphenyl)-9-methyl-7-[4-(propylamino)piperidin-1-yl]-4H-pyrido[1,2-a]pyrimidin-4-one
2-(3,4-dimethoxyphenyl)-9-ethyl-7-(1,2,3,6-tetrahydropyridin-4-yl)-4H-pyrido[1,2-a]pyrimidin-4-one
7-(2-methylimidazo[1,2-a]pyridin-6-yl)-2-(piperidin-4-yl)-4H-pyrido[1,2-a]pyrimidin-4-one
7-(8-fluoro-2-methylimidazo[1,2-a]pyridin-6-yl)-2-(piperidin-4-yl)-4H-pyrido[1,2-a]pyrimidin-4-one
7-(8-fluoro-2-methylimidazo[1,2-a]pyridin-6-yl)-2-(1-methyl-1,2,3,6-tetrahydropyridin-4-yl)-4H-pyrido[1,2-a]pyrimidin-4-one
7-(4-cyclopropylpiperazin-1-yl)-2-(8-fluoro-2-methylimidazo[1,2-a]pyridin-6-yl)-4H-pyrido[1,2-a]pyrimidin-4-one
2-(1,3-dimethylpyrrolo[1,2-a]pyrazin-7-yl)-7-(1,2,3,6-tetrahydropyridin-4-yl)-4H-pyrazino[1,2-a]pyrimidin-4-one
2-(3,4-dimethoxyphenyl)-7-[(8aR)-hexahydropyrrolo[1,2-a]pyrazin-2(1H)-yl]-9-methyl-4H-pyrido[1,2-a]pyrimidin-4-one
2-(3,4-dimethoxyphenyl)-9-ethyl-7-(1-methyl-1,2,3,6-tetrahydropyridin-4-yl)-4H-pyrido[1,2-a]pyrimidin-4-one
2-(3,4-dimethoxyphenyl)-9-methyl-7-[4-(propan-2-ylamino)piperidin-1-yl]-4H-pyrido[1,2-a]pyrimidin-4-one 2-(3,4-dimethoxyphenyl)-7-[(8aS)-hexahydropyrrolo[1,2-a]pyrazin-2(1H)-yl]-9-methyl-4H-pyrido[1,2-a]pyrimidin-4-one
2-(3,4-dimethoxyphenyl)-9-ethyl-7-(1-ethyl-1,2,3,6-tetrahydropyridin-4-yl)-4H-pyrido[1,2-a]pyrimidin-4-one
2-(3,4-dimethoxyphenyl)-9-methyl-7-[4-(morpholin-4-yl)piperidin-1-yl]-4H-pyrido[1,2-a]pyrimidin-4-one
2-(6-methylpyrazolo[1,5-a]pyrazin-2-yl)-7-(piperazin-1-yl)-4H-pyrido[1,2-a]pyrimidin-4-one
2-(2-methyl-1,3-benzoxazol-6-yl)-7-(1,2,3,6-tetrahydropyridin-4-yl)-4H-pyrazino[1,2-a]pyrimidin-4-one hydrochloride (1:1)
2-(2-methyl-1,3-benzoxazol-6-yl)-7-(1-methyl-1,2,3,6-tetrahydropyridin-4-yl)-4H-pyrazino[1,2-a]pyrimidin-4-one
7-(1-ethyl-1,2,3,6-tetrahydropyridin-4-yl)-2-(2-methyl-1,3-benzoxazol-6-yl)-4H-pyrazino[1,2-a]pyrimidin-4-one
2-(2-methyl-1,3-benzothiazol-6-yl)-7-(piperidin-4-yl)-4H-pyrido[1,2-a]pyrimidin-4-one
2-(4,6-dimethylpyrazolo[1,5-a]pyrazin-2-yl)-7-[4-(pyrrolidin-1-yl)piperidin-1-yl]-4H-pyrido[1,2-a]pyrimidin-4-one
7-(1,4'-bipiperidin-1'-yl)-2-(4,6-dimethylpyrazolo[1,5-a]pyrazin-2-yl)-4H-pyrido[1,2-a]pyrimidin-4-one
2-(4,6-dimethylpyrazolo[1,5-a]pyrazin-2-yl)-7-[4-(4-methylpiperazin-1-yl)piperidin-1-yl]-4H-pyrido[1,2-a]pyrimidin-4-one
2-(4,6-dimethylpyrazolo[1,5-a]pyrazin-2-yl)-7-[4-(morpholin-4-yl)piperidin-1-yl]-4H-pyrido[1,2-a]pyrimidin-4-one
2-(2-methylimidazo[1,2-a]pyridin-6-yl)-7-(1,2,3,6-tetrahydropyridin-4-yl)-4H-pyrido[1,2-a]pyrimidin-4-one
2-(2-methylimidazo[1,2-a]pyridin-6-yl)-7-(1-methyl-1,2,3,6-tetrahydropyridin-4-yl)-4H-pyrido[1,2-a]pyrimidin-4-one
7-(1-ethyl-1,2,3,6-tetrahydropyridin-4-yl)-2-(2-methylimidazo[1,2-a]pyridin-6-yl)-4H-pyrido[1,2-a]pyrimidin-4-one
7-[4-(dimethylamino)piperidin-1-yl]-2-(2-methylimidazo[1,2-a]pyridin-6-yl)-4H-pyrido[1,2-a]pyrimidin-4-one
2-(3,4-dimethoxyphenyl)-7-{4-[(2-hydroxyethyl)amino]piperidin-1-yl}-9-methyl-4H-pyrido[1,2-a]pyrimidin-4-one
2-(3,4-dimethoxyphenyl)-9-ethyl-7-(1-methylpiperidin-4-yl)-4H-pyrido[1,2-a]pyrimidin-4-one
7-[4-(diethylamino)piperidin-1-yl]-2-(3,4-dimethoxyphenyl)-9-methyl-4H-pyrido[1,2-a]pyrimidin-4-one
2-(3,4-dimethoxyphenyl)-9-ethyl-7-(1-ethylpiperidin-4-yl)-4H-pyrido[1,2-a]pyrimidin-4-one
2-(2-methylimidazo[1,2-a]pyridin-6-yl)-7-[4-(pyrrolidin-1-yl)piperidin-1-yl]-4H-pyrido[1,2-a]pyrimidin-4-one
2-(2-methylimidazo[1,2-a]pyridin-6-yl)-7-(piperidin-4-yl)-4H-pyrido[1,2-a]pyrimidin-4-one
2-(2-methyl-1,3-benzothiazol-6-yl)-7-(1-methylpiperidin-4-yl)-4H-pyrido[1,2-a]pyrimidin-4-one
7-(4-methylpiperazin-1-yl)-2-(6-methylpyrazolo[1,5-a]pyrazin-2-yl)-4H-pyrido[1,2-a]pyrimidin-4-one
7-[(3S)-3-methylpiperazin-1-yl]-2-(6-methylpyrazolo[1,5-a]pyrazin-2-yl)-4H-pyrido[1,2-a]pyrimidin-4-one
7-[(3R,5S)-3,5-dimethylpiperazin-1-yl]-2-(6-methylpyrazolo[1,5-a]pyrazin-2-yl)-4H-pyrido[1,2-a]pyrimidin-4-one
2-(1-methyl-1H-indazol-5-yl)-7-(1,2,3,6-tetrahydropyridin-4-yl)-4H-pyrido[1,2-a]pyrimidin-4-one
2-[6-(dimethylamino)pyridin-3-yl]-7-(1,2,3,6-tetrahydropyridin-4-yl)-4H-pyrido[1,2-a]pyrimidin-4-one
7-[4-(diethylamino)piperidin-1-yl]-2-(2-methylimidazo[1,2-a]pyridin-6-yl)-4H-pyrido[1,2-a]pyrimidin-4-one
2-(3,4-dimethoxyphenyl)-7-{4-[(2-hydroxyethyl)(methyl)amino]piperidin-1-yl}-9-methyl-4H-pyrido[1,2-a]pyrimidin-4-one
2-(3,4-dimethoxyphenyl)-9-ethyl-7-[(3R)-3-methylpiperazin-1-yl]-4H-pyrido[1,2-a]pyrimidin-4-one
2-(2-methylimidazo[1,2-a]pyridin-6-yl)-7-(1-methylpiperidin-4-yl)-4H-pyrido[1,2-a]pyrimidin-4-one
2-(1-methyl-1H-indazol-5-yl)-7-(1-methyl-1,2,3,6-tetrahydropyridin-4-yl)-4H-pyrido[1,2-a]pyrimidin-4-one
2-[6-(dimethylamino)pyridin-3-yl]-7-(1-methyl-1,2,3,6-tetrahydropyridin-4-yl)-4H-pyrido[1,2-a]pyrimidin-4-one
7-[4-(diethylamino)piperidin-1-yl]-2-(4,6-dimethylpyrazolo[1,5-a]pyrazin-2-yl)-4H-pyrido[1,2-a]pyrimidin-4-one
2-(4,6-dimethylpyrazolo[1,5-a]pyrazin-2-yl)-7-(piperidin-4-yl)-4H-pyrido[1,2-a]pyrimidin-4-one
2-(4,6-dimethylpyrazolo[1,5-a]pyrazin-2-yl)-7-(1-methylpiperidin-4-yl)-4H-pyrido[1,2-a]pyrimidin-4-one
2-(4,6-dimethylpyrazolo[1,5-a]pyrazin-2-yl)-7-(1-ethylpiperidin-4-yl)-4H-pyrido[1,2-a]pyrimidin-4-one
2-(3,4-dimethoxyphenyl)-9-ethyl-7-[(8aR)-hexahydropyrrolo[1,2-a]pyrazin-2(1H)-yl]-4H-pyrido[1,2-a]pyrimidin-4-one
2-(3,4-dimethoxyphenyl)-7-{4-[(2-methoxyethyl)amino]piperidin-1-yl}-9-methyl-4H-pyrido[1,2-a]pyrimidin-4-one
2-(4,6-dimethylpyrazolo[1,5-a]pyrazin-2-yl)-9-methyl-7-(4-methylpiperazin-1-yl)-4H-pyrido[1,2-a]pyrimidin-4-one
2-(4,6-dimethylpyrazolo[1,5-a]pyrazin-2-yl)-7-[(8aR)-hexahydropyrrolo[1,2-a]pyrazin-2(1H)-yl]-9-methyl-4H-pyrido[1,2-a]pyrimidin-4-one
7-[4-(dimethylamino)piperidin-1-yl]-2-(4,6-dimethylpyrazolo[1,5-a]pyrazin-2-yl)-9-methyl-4H-pyrido[1,2-a]pyrimidin-4-one
7-(2-methylimidazo[1,2-a]pyridin-6-yl)-2-(1-methylpiperidin-4-yl)-4H-pyrido[1,2-a]pyrimidin-4-one
7-(2-methylimidazo[1,2-a]pyridin-6-yl)-2-[1-(propan-2-yl)piperidin-4-yl]-4H-pyrido[1,2-a]pyrimidin-4-one
7-(8-fluoro-2-methylimidazo[1,2-a]pyridin-6-yl)-2-(1-methylpiperidin-4-yl)-4H-pyrido[1,2-a]pyrimidin-4-one
7-(1-ethyl-1,2,3,6-tetrahydropyridin-4-yl)-2-(1-methyl-1H-indazol-5-yl)-4H-pyrido[1,2-a]pyrimidin-4-one
2-(1-methyl-1H-indazol-5-yl)-7-(1-propyl-1,2,3,6-tetrahydropyridin-4-yl)-4H-pyrido[1,2-a]pyrimidin-4-one
2-[6-(dimethylamino)pyridin-3-yl]-7-(piperidin-4-yl)-4H-pyrido[1,2-a]pyrimidin-4-one
7-(4-ethylpiperazin-1-yl)-2-(6-methylpyrazolo[1,5-a]pyrazin-2-yl)-4H-pyrido[1,2-a]pyrimidin-4-one
7-[(8aR)-hexahydropyrrolo[1,2-a]pyrazin-2(1H)-yl]-2-(6-methylpyrazolo[1,5-a]pyrazin-2-yl)-4H-pyrido[1,2-a]pyrimidin-4-one
7-[4-(dimethylamino)piperidin-1-yl]-2-(6-methylpyrazolo[1,5-a]pyrazin-2-yl)-4H-pyrido[1,2-a]pyrimidin-4-one
7-[4-(2-hydroxyethyl)piperazin-1-yl]-2-(6-methylpyrazolo[1,5-a]pyrazin-2-yl)-4H-pyrido[1,2-a]pyrimidin-4-one
2-(2-methylimidazo[1,2-a]pyridin-6-yl)-7-(1-propylpiperidin-4-yl)-4H-pyrido[1,2-a]pyrimidin-4-one
7-[1-(2-hydroxyethyl)-1,2,3,6-tetrahydropyridin-4-yl]-2-(1-methyl-1H-indazol-5-yl)-4H-pyrido[1,2-a]pyrimidin-4-one
7-[(3R)-3-methylpiperazin-1-yl]-2-(6-methylpyrazolo[1,5-a]pyrazin-2-yl)-4H-pyrido[1,2-a]pyrimidin-4-one
2-(6-methylpyrazolo[1,5-a]pyrazin-2-yl)-7-(1,2,3,6-tetrahydropyridin-4-yl)-4H-pyrido[1,2-a]pyrimidin-4-one
2-methyl-2H-indazol-5-yl)-7-(1,2,3,6-tetrahydropyridin-4-yl)-4H-pyrido[1,2-a]pyrimidin-4-one
2-(1-methyl-1H-indazol-5-yl)-7-(1-methylpiperidin-4-yl)-4H-pyrido[1,2-a]pyrimidin-4-one 2-(2-methyl-2H-indazol-5-yl)-7-(1-methyl-1,2,3,6-tetrahydropyridin-4-yl)-4H-pyrido[1,2-a]pyrimidin-4-one 7-(1-ethyl-1,2,3,6-tetrahydropyridin-4-yl)-2-(2-methyl-2H-indazol-5-yl)-4H-pyrido[1,2-a]pyrimidin-4-one 7-(1-ethylpiperidin-4-yl)-2-(2-methylimidazo[1,2-a]pyridin-6-yl)-4H-pyrido[1,2-a]pyrimidin-4-one 2-(1,3-dimethylpyrrolo[1,2-a]pyrazin-7-yl)-7-[1-(propan-2-yl)-1,2,3,6-tetrahydropyridin-4-yl]-4H-pyrazino[1,2-a]pyrimidin-4-one 2-(4,6-dimethylpyrazolo[1,5-a]pyrazin-2-yl)-9-methyl-7-(1,2,3,6-tetrahydropyridin-4-yl)-4H-pyrido[1,2-a]pyrimidin-4-one 2-(4,6-dimethylpyrazolo[1,5-a]pyrazin-2-yl)-9-methyl-7-(1-methyl-1,2,3,6-tetrahydropyridin-4-yl)-4H-pyrido[1,2-a]pyrimidin-4-one 2-(4,6-dimethylpyrazolo[1,5-a]pyrazin-2-yl)-7-(1-ethyl-1,2,3,6-tetrahydropyridin-4-yl)-9-methyl-4H-pyrido[1,2-a]pyrimidin-4-one 7-(1-cyclopropyl-1,2,3,6-tetrahydropyridin-4-yl)-2-(4,6-dimethylpyrazolo[1,5-a]pyrazin-2-yl)-9-methyl-4H-pyrido[1,2-a]pyrimidin-4-one 2-(6-methylpyrazolo[1,5-a]pyrazin-2-yl)-7-(1-methyl-1,2,3,6-tetrahydropyridin-4-yl)-4H-pyrido[1,2-a]pyrimidin-4-one 7-(1-ethyl-1,2,3,6-tetrahydropyridin-4-yl)-2-(6-methylpyrazolo[1,5-a]pyrazin-2-yl)-4H-pyrido[1,2-a]pyrimidin-4-one 2-(5,7-dimethylfuro[2,3-c]pyridin-2-yl)-7-(piperazin-1-yl)-4H-pyrido[1,2-a]pyrimidin-4-one 2-(5,7-dimethylfuro[2,3-c]pyridin-2-yl)-7-(4-methylpiperazin-1-yl)-4H-pyrido[1,2-a]pyrimidin-4-one 2-(5,7-dimethylfuro[2,3-c]pyridin-2-yl)-7-[(3S)-3-methylpiperazin-1-yl]-4H-pyrido[1,2-a]pyrimidin-4-one 2-(1-methyl-1H-indazol-5-yl)-7-(4-methylpiperazin-1-yl)-4H-pyrido[1,2-a]pyrimidin-4-one 2-(1-methyl-1H-indazol-5-yl)-7-(piperazin-1-yl)-4H-pyrido[1,2-a]pyrimidin-4-one 7-[4-(dimethylamino)piperidin-1-yl]-2-(1-methyl-1H-indazol-5-yl)-4H-pyrido[1,2-a]pyrimidin-4-one 7-(4-methyl-1,4-diazepan-1-yl)-2-(1-methyl-1H-indazol-5-yl)-4H-pyrido[1,2-a]pyrimidin-4-one 7-(1-ethyl-1,2,3,6-tetrahydropyridin-4-yl)-2-(2-methyl-1,3-benzoxazol-6-yl)-4H-pyrimido[1,2-a]pyridin-4-one 2-(8-chloro-2-methylimidazo[1,2-a]pyridin-6-yl)-7-(4-ethylpiperazin-1-yl)-4H-pyrido[1,2-a]pyrimidin-4-one 2-(8-chloro-2-methylimidazo[1,2-a]pyridin-6-yl)-7-[(3R)-4-ethyl-3-methylpiperazin-1-yl]-4H-pyrido[1,2-a]pyrimidin-4-one 2-(8-chloro-2-methylimidazo[1,2-a]pyridin-6-yl)-7-[(3S)-4-ethyl-3-methylpiperazin-1-yl]-4H-pyrido[1,2-a]pyrimidin-4-one 2-(8-chloro-2-methylimidazo[1,2-a]pyridin-6-yl)-7-[(3R)-3-methyl-4-(propan-2-yl)piperazin-1-yl]-4H-pyrido[1,2-a]pyrimidin-4-one 2-(8-chloro-2-methylimidazo[1,2-a]pyridin-6-yl)-7-[(3S)-3-methyl-4-(propan-2-yl)piperazin-1-yl]-4H-pyrido[1,2-a]pyrimidin-4-one 2-(2-methyl-1,3-benzoxazol-6-yl)-7-(piperidin-4-yl)-4H-pyrimido[1,2-b]pyridazin-4-one 2-(2-methyl-1,3-benzoxazol-6-yl)-7-(1-methylpiperidin-4-yl)-4H-pyrimido[1,2-b]pyridazin-4-one 7-(1-ethylpiperidin-4-yl)-2-(2-methyl-1,3-benzoxazol-6-yl)-4H-pyrimido[1,2-b]pyridazin-4-one 2-(4,6-dimethylpyrazolo[1,5-a]pyrazin-2-yl)-7-(piperidin-4-yl)-4H-pyrazino[1,2-a]pyrimidin-4-one 2-(4,6-dimethylpyrazolo[1,5-a]pyrazin-2-yl)-7-(1-methylpiperidin-4-yl)-4H-pyrazino[1,2-a]pyrimidin-4-one 2-(4,6-dimethylpyrazolo[1,5-a]pyrazin-2-yl)-7-(1-ethylpiperidin-4-yl)-4H-pyrazino[1,2-a]pyrimidin-4-one 2-(1-methyl-1H-indazol-5-yl)-7-(1,2,3,6-tetrahydropyridin-4-yl)-4H-pyrazino[1,2-a]pyrimidin-4-one 2-(1-methyl-1H-indazol-5-yl)-7-(1-methyl-1,2,3,6-tetrahydropyridin-4-yl)-4H-pyrazino[1,2-a]pyrimidin-4-one 7-(1-ethyl-1,2,3,6-tetrahydropyridin-4-yl)-2-(1-methyl-1H-indazol-5-yl)-4H-pyrazino[1,2-a]pyrimidin-4-one 2-(4,6-dimethylpyrazolo[1,5-a]pyrazin-2-yl)-7-(4-ethylpiperazin-1-yl)-9-methyl-4H-pyrido[1,2-a]pyrimidin-4-one 2-(4,6-dimethylpyrazolo[1,5-a]pyrazin-2-yl)-9-methyl-7-[(3R)-3-methylpiperazin-1-yl]-4H-pyrido[1,2-a]pyrimidin-4-one 7-[(3R)-3,4-dimethylpiperazin-1-yl]-2-(4,6-dimethylpyrazolo[1,5-a]pyrazin-2-yl)-9-methyl-4H-pyrido[1,2-a]pyrimidin-4-one 2-(4,6-dimethylpyrazolo[1,5-a]pyrazin-2-yl)-7-[(3R)-4-ethyl-3-methylpiperazin-1-yl]-9-methyl-4H-pyrido[1,2-a]pyrimidin-4-one 2-(4,6-dimethylpyrazolo[1,5-a]pyrazin-2-yl)-7-(piperidin-4-yl)-4H-pyrimido[1,2-b]pyridazin-4-one 2-(4,6-dimethylpyrazolo[1,5-a]pyrazin-2-yl)-7-(1-methylpiperidin-4-yl)-4H-pyrimido[1,2-a]pyridazin-4-one 2-(4,6-dimethylpyrazolo[1,5-a]pyrazin-2-yl)-7-(1-ethylpiperidin-4-yl)-4H-pyrimido[1,2-a]pyridazin-4-one 2-(4,6-dimethylpyrazolo[1,5-a]pyrazin-2-yl)-7-(octahydro-5H-pyrrolo[3,2-c]pyridin-5-yl)-4H-pyrido[1,2-a]pyrimidin-4-one 2-(8-chloro-2-methylimidazo[1,2-a]pyridin-6-yl)-7-(piperidin-4-yl)-4H-pyrido[1,2-a]pyrimidin-4-one 2-(8-chloro-2-methylimidazo[1,2-a]pyridin-6-yl)-7-(1-methylpiperidin-4-yl)-4H-pyrido[1,2-a]pyrimidin-4-one 2-(8-chloro-2-methylimidazo[1,2-a]pyridin-6-yl)-7-(1-ethylpiperidin-4-yl)-4H-pyrido[1,2-a]pyrimidin-4-one 2-(8-chloro-2-methylimidazo[1,2-a]pyridin-6-yl)-7-[1-(propan-2-yl)piperidin-4-yl]-4H-pyrido[1,2-a]pyrimidin-4-one 2-(4,6-dimethylpyrazolo[1,5-a]pyrazin-2-yl)-9-methyl-7-(4-methyl-1,4-diazepan-1-yl)-4H-pyrido[1,2-a]pyrimidin-4-one 2-(2-methyl-2H-indazol-5-yl)-7-(piperidin-4-yl)-4H-pyrimido[1,2-b]pyridazin-4-one 2-(2-methyl-2H-indazol-5-yl)-7-(1-methylpiperidin-4-yl)-4H-pyrimido[1,2-b]pyridazin-4-one 7-(1-ethylpiperidin-4-yl)-2-(2-methyl-2H-indazol-5-yl)-4H-pyrimido[1,2-b]pyridazin-4-one 2-(8-chloro-2-methylimidazo[1,2-a]pyridin-6-yl)-7-(1-methylpiperidin-4-yl)-4H-pyrimido[1,2-a]pyridazin-4-one 2-(8-chloro-2-methylimidazo[1,2-a]pyridin-6-yl)-7-(1-ethylpiperidin-4-yl)-4H-pyrimido[1,2-a]pyridazin-4-one 2-(8-chloro-2-methylimidazo[1,2-a]pyridin-6-yl)-7-[1-(2-hydroxyethyl)piperidin-4-yl]-4H-pyrimido[1,2-b]pyridazin-4-one 2-(5,7-dimethylfuro[2,3-c]pyridin-2-yl)-7-[(3R,5S)-3,5-dimethylpiperazin-1-yl]-4H-pyrido[1,2-a]pyrimidin-4-one 7-[4-(dimethylamino)piperidin-1-yl]-2-(5,7-dimethylfuro[2,3-c]pyridin-2-yl)-4H-pyrido[1,2-a]pyrimidin-4-one 2-(5,7-dimethylfuro[2,3-c]pyridin-2-yl)-7-[4-(2-hydroxyethyl)piperazin-1-yl]-4H-pyrido[1,2-a]pyrimidin-4-one 2-(4,6-dimethylpyrazolo[1,5-a]pyrazin-2-yl)-7-[1-(2-hydroxyethyl)piperidin-4-yl]-4H-pyrido[1,2-a]pyrimidin-4-one 2-(4,6-dimethylpyrazolo[1,5-a]pyrazin-2-yl)-7-[4-(2-hydroxyethyl)piperazin-1-yl]-4H-pyrido[1,2-a]pyrimidin-4-one 2-(4,6-dimethylpyrazolo[1,5-a]pyrazin-2-yl)-7-[(3R)-4-(2-hydroxyethyl)-3-methylpiperazin-1-yl]-4H-pyrido[1,2-a]pyrimidin-4-one 2-(8-chloro-2-methylimidazo[1,2-a]pyridin-6-yl)-7-[(3S)-4-(2-methoxyethyl)-3-methylpiperazin-1-yl]-4H-pyrido[1,2-a]pyrimidin-4-one 2-(8-chloro-2-methylimidazo[1,2-a]pyridin-6-yl)-7-{(3S)-4-[2-(2-hydroxyethoxy)ethyl]-3-methylpiperazin-1-yl}-4H-pyrido[1,2-a]pyrimidin-4-one 2-(8-chloro-2-methylimidazo[1,2-a]pyridin-6-yl)-7-[(3S)-4-cyclopropyl-3-methylpiperazin-1-yl]-4H-pyrido[1,2-a]pyrimidin-4-one 2-(8-chloro-2-methylimidazo[1,2-a]pyridin-6-yl)-7-[(3S)-4-cyclobutyl-3-methylpiperazin-1-yl]-4H-pyrido[1,2-a]pyrimidin-4-one 2-(8-chloro-2-methylimidazo[1,2-a]pyridin-6-yl)-7-[(3S)-4-(2-hydroxyethyl)-3-methylpiperazin-1-yl]-4H-pyrido[1,2-a]pyrimidin-4-one 2-(8-fluoro-2-methylimidazo[1,2-a]pyridin-6-yl)-7-[(3S)-4-(2-methoxyethyl)-3-methylpiperazin-1-yl]-4H-pyrido[1,2-a]pyrimidin-4-one 2-(8-fluoro-2-methylimidazo[1,2-a]pyridin-6-yl)-7-[(3S)-4-(2-hydroxyethyl)-3-methylpiperazin-1-yl]-4H-pyrido[1,2-a]pyrimidin-4-one 2-(8-fluoro-2-methylimidazo[1,2-a]pyridin-6-yl)-7-{(3S)-4-[2-(2-hydroxyethoxy)ethyl]-3-methylpiperazin-1-yl}-4H-pyrido[1,2-a]pyrimidin-4-one 2-(8-fluoro-2-methylimidazo[1,2-a]pyridin-6-yl)-7-[(3S)-3-methyl-4-(propan-2-yl)piperazin-1-yl]-4H-pyrido[1,2-a]pyrimidin-4-one 7-[(3S)-4-cyclopropyl-3-methylpiperazin-1-yl]-2-(8-fluoro-2-methylimidazo[1,2-a]pyridin-6-yl)-4H-pyrido[1,2-a]pyrimidin-4-one 7-[(3S)-4-cyclobutyl-3-methylpiperazin-1-yl]-2-(8-fluoro-2-methylimidazo[1,2-a]pyridin-6-yl)-4H-pyrido[1,2-a]pyrimidin-4-one 7-(3,3-dimethylpiperazin-1-yl)-2-(4,6-dimethylpyrazolo[1,5-a]pyrazin-2-yl)-9-methyl-4H-pyrido[1,2-a]pyrimidin-4-one 2-(1-methyl-1H-indazol-5-yl)-7-[(3R)-3-methylpiperazin-1-yl]-4H-pyrido[1,2-a]pyrimidin-4-one 2-(4-ethyl-6-methylpyrazolo[1,5-a]pyrazin-2-yl)-7-(piperazin-1-yl)-4H-pyrido[1,2-a]pyrimidin-4-one 2-(4-ethyl-6-methylpyrazolo[1,5-a]pyrazin-2-yl)-7-(4-methylpiperazin-1-yl)-4H-pyrido[1,2-a]pyrimidin-4-one 2-(4-ethyl-6-methylpyrazolo[1,5-a]pyrazin-2-yl)-7-(4-ethylpiperazin-1-yl)-4H-pyrido[1,2-a]pyrimidin-4-one 2-(4-ethyl-6-methylpyrazolo[1,5-a]pyrazin-2-yl)-7-[4-(2-hydroxyethyl)piperazin-1-yl]-4H-pyrido[1,2-a]pyrimidin-4-one 7-[4-(dimethylamino)piperidin-1-yl]-2-(4-ethyl-6-methylpyrazolo[1,5-a]pyrazin-2-yl)-4H-pyrido[1,2-a]pyrimidin-4-one 7-[4-(diethylamino)piperidin-1-yl]-2-(4-ethyl-6-methylpyrazolo[1,5-a]pyrazin-2-yl)-4H-pyrido[1,2-a]pyrimidin-4-one 7-[(3R,5S)-3,5-dimethylpiperazin-1-yl]-2-(1-methyl-1H-indazol-5-yl)-4H-pyrido[1,2-a]pyrimidin-4-one 2-(1-methyl-1H-indazol-5-yl)-7-[(3S)-3-methylpiperazin-1-yl]-4H-pyrido[1,2-a]pyrimidin-4-one 2-(2-methylimidazo[1,2-a]pyridin-6-yl)-7-[1-(propan-2-yl)piperidin-4-yl]-4H-pyrido[1,2-a]pyrimidin-4-one 2-(2-methylimidazo[1,2-a]pyridin-7-yl)-7-(piperazin-1-yl)-4H-pyrido[1,2-a]pyrimidin-4-one 2-(2-methylimidazo[1,2-a]pyridin-7-yl)-7-(piperidin-4-yl)-4H-pyrido[1,2-a]pyrimidin-4-one 2-(2-methylimidazo[1,2-a]pyridin-7-yl)-7-(4-methylpiperazin-1-yl)-4H-pyrido[1,2-a]pyrimidin-4-one 7-(4-ethylpiperazin-1-yl)-2-(2-methylimidazo[1,2-a]pyridin-7-yl)-4H-pyrido[1,2-a]pyrimidin-4-one 2-(2-methylimidazo[1,2-a]pyridin-7-yl)-7-(1-methylpiperidin-4-yl)-4H-pyrido[1,2-a]pyrimidin-4-one 7-(1-ethylpiperidin-4-yl)-2-(2-methylimidazo[1,2-a]pyridin-7-yl)-4H-pyrido[1,2-a]pyrimidin-4-one 2-(4,6-dimethylpyrazolo[1,5-a]pyrazin-2-yl)-9-methyl-7-[(3S)-3-methylpiperazin-1-yl]-4H-pyrido[1,2-a]pyrimidin-4-one 7-[(3R,5S)-3,5-dimethylpiperazin-1-yl]-2-(4,6-dimethylpyrazolo[1,5-a]pyrazin-2-yl)-9-methyl-4H-pyrido[1,2-a]pyrimidin-4-one 7-[(3S)-3,4-dimethylpiperazin-1-yl]-2-(4,6-dimethylpyrazolo[1,5-a]pyrazin-2-yl)-9-methyl-4H-pyrido[1,2-a]pyrimidin-4-one 2-(4,6-dimethylpyrazolo[1,5-a]pyrazin-2-yl)-9-methyl-7-[(3R,5S)-3,4,5-trimethylpiperazin-1-yl]-4H-pyrido[1,2-a]pyrimidin-4-one 2-(2-methylimidazo[1,2-a]pyridin-6-yl)-7-[1-(propan-2-yl)-1,2,3,6-tetrahydropyridin-4-yl]-4H-pyrido[1,2-a]pyrimidin-4-one 2-(2-methyl-2H-indazol-5-yl)-7-(piperidin-4-yl)-4H-pyrazino[1,2-a]pyrimidin-4-one 2-(2-methyl-2H-indazol-5-yl)-7-(1-methylpiperidin-4-yl)-4H-pyrazino[1,2-a]pyrimidin-4-one 7-(1-ethylpiperidin-4-yl)-2-(2-methyl-2H-indazol-5-yl)-4H-pyrazino[1,2-a]pyrimidin-4-one 7-[1-(2-hydroxyethyl)piperidin-4-yl]-2-(2-methyl-2H-indazol-5-yl)-4H-pyrazino[1,2-a]pyrimidin-4-one 7-{4-[(dimethylamino)methyl]piperidin-1-yl}-2-(4,6-dimethylpyrazolo[1,5-a]pyrazin-2-yl)-4H-pyrido[1,2-a]pyrimidin-4-one 2-(4,6-dimethylpyrazolo[1,5-a]pyrazin-2-yl)-7-[4-(pyrrolidin-1-ylmethyl)piperidin-1-yl]-4H-pyrido[1,2-a]pyrimidin-4-one 2-(4,6-dimethylpyrazolo[1,5-a]pyrazin-2-yl)-7-[4-(piperidin-1-ylmethyl)piperidin-1-yl]-4H-pyrido[1,2-a]pyrimidin-4-one 2-(3,4-dimethoxyphenyl)-7-{4-[(dimethylamino)methyl]piperidin-1-yl}-4H-pyrido[1,2-a]pyrimidin-4-one 2-(3,4-dimethoxyphenyl)-7-[4-(pyrrolidin-1-ylmethyl)piperidin-1-yl]-4H-pyrido[1,2-a]pyrimidin-4-one 2-(3,4-dimethoxyphenyl)-7-[4-(piperidin-1-ylmethyl)piperidin-1-yl]-4H-pyrido[1,2-a]pyrimidin-4-one 7-[1-(2-hydroxyethyl)piperidin-4-yl]-2-(2-methylimidazo[1,2-a]pyridin-6-yl)-4H-pyrido[1,2-a]pyrimidin-4-one 7-[1-(2-hydroxyethyl)-1,2,3,6-tetrahydropyridin-4-yl]-2-(2-methylimidazo[1,2-a]pyridin-6-yl)-4H-pyrido[1,2-a]pyrimidin-4-one 2-(2-methyl-2H-indazol-5-yl)-7-(1-methylpiperidin-4-yl)-4H-pyrido[1,2-a]pyrimidin-4-one 2-(2-methylimidazo[1,2-a]pyridin-6-yl)-7-(1-methylpiperidin-4-yl)-4H-pyrazino[1,2-a]pyrimidin-4-one 7-(1-ethylpiperidin-4-yl)-2-(2-methylimidazo[1,2-a]pyridin-6-yl)-4H-pyrazino[1,2-a]pyrimidin-4-one 7-[1-(2-hydroxyethyl)piperidin-4-yl]-2-(2-methylimidazo[1,2-a]pyridin-6-yl)-4H-pyrazino[1,2-a]pyrimidin-4-one 2-(4,6-dimethylpyrazolo[1,5-a]pyrazin-2-yl)-7-{4-[(2-hydroxyethyl)(methyl)amino]piperidin-1-yl}-9-methyl-4H-pyrido[1,2-a]pyrimidin-4-one 2-(4,6-dimethylpyrazolo[1,5-a]pyrazin-2-yl)-9-methyl-7-[4-(propylamino)piperidin-1-yl]-4H-pyrido[1,2-a]pyrimidin-4-one 7-(4-amino-4-methylpiperidin-1-yl)-2-(4,6-dimethylpyrazolo[1,5-a]pyrazin-2-yl)-4H-pyrido[1,2-a]pyrimidin-4-one 2-(2-methylimidazo[1,2-a]pyridin-6-yl)-7-(piperidin-4-yl)-4H-pyrazino[1,2-a]pyrimidin-4-one 2-(2-methyl-2H-indazol-5-yl)-7-(piperazin-1-yl)-4H-pyrazino[1,2-a]pyrimidin-4-one 2-(8-chloro-2-methylimidazo[1,2-a]pyridin-6-yl)-7-(piperidin-4-yl)-4H-pyrazino[1,2-a]pyrimidin-4-one 2-(2,8-dimethylimidazo[1,2-a]pyridin-6-yl)-7-(piperidin-4-yl)-4H-pyrazino[1,2-a]pyrimidin-4-one 2-(2-methyl-2H-indazol-5-yl)-7-(4-methylpiperazin-1-yl)-4H-pyrazino[1,2-a]pyrimidin-4-one 7-(4-ethylpiperazin-1-yl)-2-(2-methyl-2H-indazol-5-yl)-4H-pyrazino[1,2-a]pyrimidin-4-one 7-[4-(2-hydroxyethyl)piperazin-1-yl]-2-(2-methyl-2H-indazol-5-yl)-4H-pyrazino[1,2-a]pyrimidin-4-one 2-(2,8-dimethylimidazo[1,2-a]pyridin-6-yl)-7-(1-methylpiperidin-4-yl)-4H-pyrazino[1,2-a]pyrimidin-4-one 2-(2,8-dimethylimidazo[1,2-a]pyridin-6-yl)-7-(1-ethylpiperidin-4-yl)-4H-pyrazino[1,2-a]pyrimidin-4-one 2-(2,8-dimethylimidazo[1,2-a]pyridin-6-yl)-7-[1-(2-hydroxyethyl)piperidin-4-yl]-4H-pyrazino[1,2-a]pyrimidin-4-one 2-(8-chloro-2-methylimidazo[1,2-a]pyridin-6-yl)-7-[1-(propan-2-yl)piperidin-4-yl]-4H-pyrazino[1,2-a]pyrimidin-4-one 2-(4,6-dimethylpyrazolo[1,5-a]pyrazin-2-yl)-7-[4-(ethylamino)piperidin-1-yl]-9-methyl-4H-pyrido[1,2-a]pyrimidin-4-one 7-{4-[bis(2-hydroxyethyl)amino]piperidin-1-yl}-2-(4,6-dimethylpyrazolo[1,5-a]pyrazin-2-yl)-9-methyl-4H-pyrido[1,2-a]pyrimidin-4-one 7-[1-(2-hydroxyethyl)piperidin-4-yl]-2-(2-methyl-1,3-benzoxazol-6-yl)-4H-pyrimido[1,2-b]pyridazin-4-one 2-(8-chloro-2-methylimidazo[1,2-a]pyridin-6-yl)-7-[1-(2-hydroxyethyl)piperidin-4-yl]-4H-pyrazino[1,2-a]pyrimidin-4-one 2-(4,6-dimethylpyrazolo[1,5-a]pyrazin-2-yl)-7-[1-(oxetan-3-yl)piperidin-4-yl]-4H-pyrido[1,2-a]pyrimidin-4-one 2-(5,7-dimethylfuro[2,3-c]pyridin-2-yl)-7-(4-ethylpiperazin-1-yl)-4H-pyrido[1,2-a]pyrimidin-4-one 2-(4,6-dimethylpyrazolo[1,5-a]pyrazin-2-yl)-7-(1-methyloctahydro-5H-pyrrolo[3,2-c]pyridin-5-yl)-4H-pyrido[1,2-a]pyrimidin-4-one 2-(1-methyl-1H-indazol-5-yl)-7-(piperidin-4-yl)-4H-pyrido[1,2-a]pyrimidin-4-one 7-(1-ethylpiperidin-4-yl)-2-(1-methyl-1H-indazol-5-yl)-4H-pyrido[1,2-a]pyrimidin-4-one 7-[1-(2-hydroxyethyl)piperidin-4-yl]-2-(1-methyl-1H-indazol-5-yl)-4H-pyrido[1,2-a]pyrimidin-4-one 2-(2-methyl-2H-indazol-5-yl)-7-(piperidin-4-yl)-4H-pyrido[1,2-a]pyrimidin-4-one 2-(2,8-dimethylimidazo[1,2-a]pyridin-6-yl)-7-(piperidin-4-yl)-4H-pyrido[1,2-a]pyrimidin-4-one 2-(2-methyl-2H-indazol-5-yl)-7-[1-(propan-2-yl)piperidin-4-yl]-4H-pyrido[1,2-a]pyrimidin-4-one 2-(4,6-dimethylpyrazolo[1,5-a]pyrazin-2-yl)-7-{4-[(2-hydroxyethyl)amino]piperidin-1-yl}-9-methyl-4H-pyrido[1,2-a]pyrimidin-4-one 2-(4,6-dimethylpyrazolo[1,5-a]pyrazin-2-yl)-9-methyl-7-[4-(methylamino)piperidin-1-yl]-4H-pyrido[1,2-a]pyrimidin-4-one 2-(4,6-dimethylpyrazolo[1,5-a]pyrazin-2-yl)-9-methyl-7-[4-(propan-2-ylamino)piperidin-1-yl]-4H-pyrido[1,2-a]pyrimidin-4-one 7-(1-ethylpiperidin-4-yl)-2-(2-methyl-2H-indazol-5-yl)-4H-pyrido[1,2-a]pyrimidin-4-one 7-[1-(2-hydroxyethyl)piperidin-4-yl]-2-(2-methyl-2H-indazol-5-yl)-4H-pyrido[1,2-a]pyrimidin-4-one 2-(2,8-dimethylimidazo[1,2-a]pyridin-6-yl)-7-(1-methylpiperidin-4-yl)-4H-pyrido[1,2-a]pyrimidin-4-one 2-(2,8-dimethylimidazo[1,2-a]pyridin-6-yl)-7-(1-ethylpiperidin-4-yl)-4H-pyrido[1,2-a]pyrimidin-4-one 2-(2,8-dimethylimidazo[1,2-a]pyridin-6-yl)-7-[1-(propan-2-yl)piperidin-4-yl]-4H-pyrido[1,2-a]pyrimidin-4-one 2-(2,8-dimethylimidazo[1,2-a]pyridin-6-yl)-7-[1-(2-hydroxyethyl)piperidin-4-yl]-4H-pyrido[1,2-a]pyrimidin-4-one 2-(4-ethyl-6-methylpyrazolo[1,5-a]pyrazin-2-yl)-7-(4-propylpiperazin-1-yl)-4H-pyrido[1,2-a]pyrimidin-4-one 2-(4-ethyl-6-methylpyrazolo[1,5-a]pyrazin-2-yl)-7-[4-(propan-2-yl)piperazin-1-yl]-4H-pyrido[1,2-a]pyrimidin-4-one 7-(4-cyclopropylpiperazin-1-yl)-2-(4-ethyl-6-methylpyrazolo[1,5-a]pyrazin-2-yl)-4H-pyrido[1,2-a]pyrimidin-4-one 7-(4-cyclobutylpiperazin-1-yl)-2-(4-ethyl-6-methylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-7-[4-(oxetan-3-yl)piperazin-1-yl]-4H-pyrido[1,2-a]pyrimidin-4-one 2-(4,6-dimethylpyrazolo[1,5-a]pyrazin-2-yl)-7-(1-ethyloctahydro-5H-pyrrolo[3,2-c]pyridin-5-yl)-4H-pyrido[1,2-a]pyrimidin-4-one 2-(4,6-dimethylpyrazolo[1,5-a]pyrazin-2-yl)-7-[1-(2-hydroxyethyl)octahydro-5H-pyrrolo[3,2-a]pyridin-5-yl]-4H-pyrido[1,2-a]pyrimidin-4-one 2-(4-methoxy-6-methylpyrazolo[1,5-a]pyrazin-2-yl)-7-(4-methylpiperazin-1-yl)-4H-pyrido[1,2-a]pyrimidin-4-one 2-(4-hydroxy-6-methylpyrazolo[1,5-a]pyrazin-2-yl)-7-(4-methylpiperazin-1-yl)-4H-pyrido[1,2-a]pyrimidin-4-one 2-(2-methylimidazo[1,2-a]pyridin-6-yl)-7-[1-(propan-2-yl)piperidin-4-yl]-4H-pyrazino[1,2-a]pyrimidin-4-one 7-(1-cyclobutylpiperidin-4-yl)-2-(2-methylimidazo[1,2-a]pyridin-6-yl)-4H-pyrazino[1,2-a]pyrimidin-4-one 7-[(3R)-3,4-dimethylpiperazin-1-yl]-2-(4-ethyl-6-methylpyrazolo[1,5-a]pyrazin-2-yl)-4H-pyrido[1,2-a]pyrimidin-4-one 7-[(3R)-4-ethyl-3-methylpiperazin-1-yl]-2-(4-ethyl-6-methylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-7-[(3R)-3-methyl-4-propylpiperazin-1-yl]-4H-pyrido[1,2-a]pyrimidin-4-one 2-(4-ethyl-6-methylpyrazolo[1,5-a]pyrazin-2-yl)-7-[(3R)-4-(2-hydroxyethyl)-3-methylpiperazin-1-yl]-4H-pyrido[1,2-a]pyrimidin-4-one 7-[(3R,5S)-3,5-dimethylpiperazin-1-yl]-2-(4-ethyl-6-methylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-7-[4-(pyrrolidin-1-yl)piperidin-1-yl]-4H-pyrido[1,2-a]pyrimidin-4-one 2-(4-ethyl-6-methylpyrazolo[1,5-a]pyrazin-2-yl)-7-[(3S)-3-methylpiperazin-1-yl]-4H-pyrido[1,2-a]pyrimidin-4-one 2-(4-ethyl-6-methylpyrazolo[1,5-a]pyrazin-2-yl)-7-(4-methyl-1,4-diazepan-1-yl)-4H-pyrido[1,2-a]pyrimidin-4-one 2-(8-ethyl-2-methylimidazo[1,2-a]pyridin-6-yl)-7-(piperazin-1-yl)-4H-pyrido[1,2-a]pyrimidin-4-one 2-(8-ethyl-2-methylimidazo[1,2-a]pyridin-6-yl)-7-[(3R)-3-methylpiperazin-1-yl]-4H-pyrido[1,2-a]pyrimidin-4-one 2-(8-ethyl-2-methylimidazo[1,2-a]pyridin-6-yl)-7-[(3S)-3-methylpiperazin-1-yl]-4H-pyrido[1,2-a]pyrimidin-4-one 2-(4,6-dimethylpyrazolo[1,5-a]pyrazin-2-yl)-7-[1-(propan-2-yl)piperidin-4-yl]-4H-pyrido[1,2-a]pyrimidin-4-one 7-(1-cyclopropylpiperidin-4-yl)-2-(4,6-dimethylpyrazolo[1,5-a]pyrazin-2-yl)-4H-pyrido[1,2-a]pyrimidin-4-one 7-(1-cyclobutylpiperidin-4-yl)-2-(4,6-dimethylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-7-[(3R)-3-methyl-4-(propan-2-yl)piperazin-1-yl]-4H-pyrido[1,2-a]pyrimidin-4-one 7-[(3R)-4-cyclopropyl-3-methylpiperazin-1-yl]-2-(4-ethyl-6-methylpyrazolo[1,5-a]pyrazin-2-yl)-4H-pyrido[1,2-a]pyrimidin-4-one 7-[(3R)-4-cyclobutyl-3-methylpiperazin-1-yl]-2-(4-ethyl-6-methylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-7-[(3R)-3-methyl-4-(oxetan-3-yl)piperazin-1-yl]-4H-pyrido[1,2-a]pyrimidin-4-one 2-(8-ethyl-2-methylimidazo[1,2-a]pyridin-6-yl)-7-[4-(2-hydroxyethyl)piperazin-1-yl]-4H-pyrido[1,2-a]pyrimidin-4-one 7-(4-cyclobutylpiperazin-1-yl)-2-(8-ethyl-2-methylimidazo[1,2-a]pyridin-6-yl)-4H-pyrido[1,2-a]pyrimidin-4-one 2-(8-ethyl-2-methylimidazo[1,2-a]pyridin-6-yl)-7-[(3R)-4-(2-hydroxyethyl)-3-methylpiperazin-1-yl]-4H-pyrido[1,2-a]pyrimidin-4-one 7-[(3R)-4-cyclobutyl-3-methylpiperazin-1-yl]-2-(8-ethyl-2-methylimidazo[1,2-a]pyridin-6-yl)-4H-pyrido[1,2-a]pyrimidin-4-one 2-(8-ethyl-2-methylimidazo[1,2-a]pyridin-6-yl)-7-[(3S)-4-(2-hydroxyethyl)-3-methylpiperazin-1-yl]-4H-pyrido[1,2-a]pyrimidin-4-one 7-[(3S)-4-cyclobutyl-3-methylpiperazin-1-yl]-2-(8-ethyl-2-methylimidazo[1,2-a]pyridin-6-yl)-4H-pyrido[1,2-a]pyrimidin-4-one 2-(4-ethyl-6-methylpyrazolo[1,5-a]pyrazin-2-yl)-7-(piperidin-4-yl)-4H-pyrazino[1,2-a]pyrimidin-4-one 2-(4-ethyl-6-methylpyrazolo[1,5-a]pyrazin-2-yl)-7-(1-methylpiperidin-4-yl)-4H-pyrazino[1,2-a]pyrimidin-4-one 2-(4-ethyl-6-methylpyrazolo[1,5-a]pyrazin-2-yl)-7-(1-ethylpiperidin-4-yl)-4H-pyrazino[1,2-a]pyrimidin-4-one 2-(4-ethyl-6-methylpyrazolo[1,5-a]pyrazin-2-yl)-7-(piperidin-4-yl)-4H-pyrido[1,2-a]pyrimidin-4-one 2-(4-ethyl-6-methylpyrazolo[1,5-a]pyrazin-2-yl)-7-(1-methylpiperidin-4-yl)-4H-pyrido[1,2-a]pyrimidin-4-one 2-(4-ethyl-6-methylpyrazolo[1,5-a]pyrazin-2-yl)-7-(1-ethylpiperidin-4-yl)-4H-pyrido[1,2-a]pyrimidin-4-one 2-(4-ethyl-6-methylpyrazolo[1,5-a]pyrazin-2-yl)-7-[1-(2-hydroxyethyl)piperidin-4-yl]-4H-pyrido[1,2-a]pyrimidin-4-one 2-(4-ethyl-6-methylpyrazolo[1,5-a]pyrazin-2-yl)-7-(1-propylpiperidin-4-yl)-4H-pyrido[1,2-a]pyrimidin-4-one 2-(4-ethyl-6-methylpyrazolo[1,5-a]pyrazin-2-yl)-7-[(3R)-3-methylpiperazin-1-yl]-4H-pyrido[1,2-a]pyrimidin-4-one 2-(4,6-dimethylpyrazolo[1,5-a]pyrazin-2-yl)-7-[1-(2-fluoroethyl)piperidin-4-yl]-4H-pyrido[1,2-a]pyrimidin-4-one 2-(4,6-dimethylpyrazolo[1,5-a]pyrazin-2-yl)-7-[1-(3-fluoropropyl)piperidin-4-yl]-4H-pyrido[1,2-a]pyrimidin-4-one 2-(4-ethyl-6-methylpyrazolo[1,5-a]pyrazin-2-yl)-7-[4-(2-fluoroethyl)piperazin-1-yl]-4H-pyrido[1,2-a]pyrimidin-4-one 2-(4-ethyl-6-methylpyrazolo[1,5-a]pyrazin-2-yl)-7-[4-(3-fluoropropyl)piperazin-1-yl]-4H-pyrido[1,2-a]pyrimidin-4-one 2-(4-ethyl-6-methylpyrazolo[1,5-a]pyrazin-2-yl)-7-[(3R)-4-(2-fluoroethyl)-3-methylpiperazin-1-yl]-4H-pyrido[1,2-a]pyrimidin-4-one 2-(4-ethyl-6-methylpyrazolo[1,5-a]pyrazin-2-yl)-7-[(3R)-4-(3-fluoropropyl)-3-methylpiperazin-1-yl]-4H-pyrido[1,2-a]pyrimidin-4-one 2-(4-ethyl-6-methylpyrazolo[1,5-a]pyrazin-2-yl)-7-[1-(2-fluoroethyl)piperidin-4-yl]-4H-pyrido[1,2-a]pyrimidin-4-one 2-(4-ethyl-6-methylpyrazolo[1,5-a]pyrazin-2-yl)-7-[1-(3-fluoropropyl)piperidin-4-yl]-4H-pyrido[1,2-a]pyrimidin-4-one 2-(4,6-dimethylpyrazolo[1,5-a]pyrazin-2-yl)-7-{(3R)-4-[2-(2-hydroxyethoxy)ethyl]-3-methylpiperazin-1-yl}-9-methyl-4H-pyrido[1,2-a]pyrimidin-4-one 2-(4,6-dimethylpyrazolo[1,5-a]pyrazin-2-yl)-9-methyl-7-(piperidin-4-yl)-4H-pyrido[1,2-a]pyrimidin-4-one 2-(4,6-dimethylpyrazolo[1,5-a]pyrazin-2-yl)-9-methyl-7-(1-methylpiperidin-4-yl)-4H-pyrido[1,2-a]pyrimidin-4-one 2-(4,6-dimethylpyrazolo[1,5-a]pyrazin-2-yl)-7-[(3R)-4-(2-hydroxyethyl)-3-methylpiperazin-1-yl]-9-methyl-4H-pyrido[1,2-a]pyrimidin-4-one 2-[8-(hydroxymethyl)-2-methylimidazo[1,2-a]pyridin-6-yl]-7-(piperazin-1-yl)-4H-pyrido[1,2-a]pyrimidin-4-one 7-[(3R,5S)-3,5-dimethylpiperazin-1-yl]-2-(8-ethyl-2-methylimidazo[1,2-a]pyridin-6-yl)-4H-pyrido[1,2-a]pyrimidin-4-one 2-(8-ethyl-2-methylimidazo[1,2-a]pyridin-6-yl)-7-(4-methyl-1,4-diazepan-1-yl)-4H-pyrido[1,2-a]pyrimidin-4-one 2-[8-(hydroxymethyl)-2-methylimidazo[1,2-a]pyridin-6-yl]-7-(4-methylpiperazin-1-yl)-4H-pyrido[1,2-a]pyrimidin-4-one 7-(4-ethylpiperazin-1-yl)-2-[8-(hydroxymethyl)-2-methylimidazo[1,2-a]pyridin-6-yl]-4H-pyrido[1,2-a]pyrimidin-4-one 2-(4-ethyl-6-methylpyrazolo[1,5-a]pyrazin-2-yl)-7-[1-(propan-2-yl)piperidin-4-yl]-4H-pyrido[1,2-a]pyrimidin-4-one 7-(1-cyclopropylpiperidin-4-yl)-2-(4-ethyl-6-methylpyrazolo[1,5-a]pyrazin-2-yl)-4H-pyrido[1,2-a]pyrimidin-4-one 7-(1-cyclobutylpiperidin-4-yl)-2-(4-ethyl-6-methylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-7-[1-(oxetan-3-yl)piperidin-4-yl]-4H-pyrido[1,2-a]pyrimidin-4-one 2-(4-cyclopropyl-6-methylpyrazolo[1,5-a]pyrazin-2-yl)-7-(piperazin-1-yl)-4H-pyrido[1,2-a]pyrimidin-4-one 2-(4-cyclopropyl-6-methylpyrazolo[1,5-a]pyrazin-2-yl)-7-(4-methylpiperazin-1-yl)-4H-pyrido[1,2-a]pyrimidin-4-one 2-(4-cyclopropyl-6-methylpyrazolo[1,5-a]pyrazin-2-yl)-7-(4-ethylpiperazin-1-yl)-4H-pyrido[1,2-a]pyrimidin-4-one 2-(4-cyclopropyl-6-methylpyrazolo[1,5-a]pyrazin-2-yl)-7-[4-(2-hydroxyethyl)piperazin-1-yl]-4H-pyrido[1,2-a]pyrimidin-4-one 2-(4,6-dimethylpyrazolo[1,5-a]pyrazin-2-yl)-7-(1-propylpiperidin-4-yl)-4H-pyrido[1,2-a]pyrimidin-4-one 2-[4-(dimethylamino)-6-methylpyrazolo[1,5-a]pyrazin-2-yl]-7-(piperazin-1-yl)-4H-pyrido[1,2-a]pyrimidin-4-one 2-(2-methyl-1H-benzimidazol-6-yl)-7-(4-methylpiperazin-1-yl)-4H-pyrido[1,2-a]pyrimidin-4-one 7-(4-ethylpiperazin-1-yl)-2-(2-methyl-1H-benzimidazol-6-yl)-4H-pyrido[1,2-a]pyrimidin-4-one
2-(2,8-dimethylimidazo[1,2-a]pyridin-6-yl)-7-(piperidin-4-yl)-4H-pyrimido[1,2-b]pyridazin-4-one
2-(2-methylimidazo[1,2-a]pyridin-6-yl)-7-(piperidin-4-yl)-4H-pyrimido[1,2-b]pyridazin-4-one
7-[1-(2,2-dimethyl-1,3-dioxan-5-yl)piperidin-4-yl]-2-(4-ethyl-6-methylpyrazolo[1,5-a]pyrazin-2-yl)-4H-pyrido[1,2-a]pyrimidin-4-one
7-[1-(1,3-dihydroxypropan-2-yl)piperidin-4-yl]-2-(4-ethyl-6-methylpyrazolo[1,5-a]pyrazin-2-yl)-4H-pyrido[1,2-a]pyrimidin-4-one
7-[(3R,5S)-3,5-dimethylpiperazin-1-yl]-2-(1,3-dimethylpyrrolo[1,2-a]pyrazin-7-yl)-4H-pyrido[1,2-a]pyrimidin-4-one
2-(8-ethyl-2-methylimidazo[1,2-a]pyridin-6-yl)-7-(piperidin-4-yl)-4H-pyrido[1,2-a]pyrimidin-4-one
2-(8-ethyl-2-methylimidazo[1,2-a]pyridin-6-yl)-7-(1-methylpiperidin-4-yl)-4H-pyrido[1,2-a]pyrimidin-4-one
2-(8-ethyl-2-methylimidazo[1,2-a]pyridin-6-yl)-7-(1-ethylpiperidin-4-yl)-4H-pyrido[1,2-a]pyrimidin-4-one
2-(8-ethyl-2-methylimidazo[1,2-a]pyridin-6-yl)-7-[1-(2-hydroxyethyl)piperidin-4-yl]-4H-pyrido[1,2-a]pyrimidin-4-one
7-[(3R)-3,4-dimethylpiperazin-1-yl]-2-(8-ethyl-2-methylimidazo[1,2-a]pyridin-6-yl)-4H-pyrido[1,2-a]pyrimidin-4-one
2-(8-ethyl-2-methylimidazo[1,2-a]pyridin-6-yl)-7-[(3R)-4-ethyl-3-methylpiperazin-1-yl]-4H-pyrido[1,2-a]pyrimidin-4-one
2-(4,6-dimethylpyrazolo[1,5-a]pyrazin-2-yl)-7-(1-ethylpiperidin-4-yl)-9-methyl-4H-pyrido[1,2-a]pyrimidin-4-one
2-(4,6-dimethylpyrazolo[1,5-a]pyrazin-2-yl)-7-[1-(2-hydroxyethyl)piperidin-4-yl]-9-methyl-4H-pyrido[1,2-a]pyrimidin-4-one
7-(1-cyclobutylpiperidin-4-yl)-2-(4,6-dimethylpyrazolo[1,5-a]pyrazin-2-yl)-9-methyl-4H-pyrido[1,2-a]pyrimidin-4-one
9-methyl-2-(2-methyl-2H-indazol-5-yl)-7-(1-methylpiperidin-4-yl)-4H-pyrido[1,2-a]pyrimidin-4-one
7-[4-(dimethylamino)-4-methylpiperidin-1-yl]-2-(4,6-dimethylpyrazolo[1,5-a]pyrazin-2-yl)-4H-pyrido[1,2-a]pyrimidin-4-one
2-(4,6-dimethylpyrazolo[1,5-a]pyrazin-2-yl)-7-[4-(ethylamino)-4-methylpiperidin-1-yl]-4H-pyrido[1,2-a]pyrimidin-4-one
2-(4,6-dimethylpyrazolo[1,5-a]pyrazin-2-yl)-7-[4-methyl-4-(propylamino)piperidin-1-yl]-4H-pyrido[1,2-a]pyrimidin-4-one
2-(4,6-dimethylpyrazolo[1,5-a]pyrazin-2-yl)-7-{4-[(2-hydroxyethyl)amino]-4-methylpiperidin-1-yl}-4H-pyrido[1,2-a]pyrimidin-4-one
7-(1-cyclobutylpiperidin-4-yl)-9-methyl-2-(2-methyl-2H-indazol-5-yl)-4H-pyrido[1,2-a]pyrimidin-4-one
7-[1-(2-hydroxyethyl)piperidin-4-yl]-9-methyl-2-(2-methyl-2H-indazol-5-yl)-4H-pyrido[1,2-a]pyrimidin-4-one
2-(4,6-dimethylpyrazolo[1,5-a]pyrazin-2-yl)-9-methyl-7-(1-propylpiperidin-4-yl)-4H-pyrido[1,2-a]pyrimidin-4-one
2-(1,3-dimethylpyrrolo[1,2-a]pyrazin-7-yl)-7-[(3R)-3-methylpiperazin-1-yl]-4H-pyrido[1,2-a]pyrimidin-4-one
2-(8-cyclopropyl-2-methylimidazo[1,2-a]pyridin-6-yl)-7-(piperazin-1-yl)-4H-pyrido[1,2-a]pyrimidin-4-one
2-(8-cyclopropyl-2-methylimidazo[1,2-a]pyridin-6-yl)-7-[(3R)-3-methylpiperazin-1-yl]-4H-pyrido[1,2-a]pyrimidin-4-one
2-(8-cyclopropyl-2-methylimidazo[1,2-a]pyridin-6-yl)-7-[(3S)-3-methylpiperazin-1-yl]-4H-pyrido[1,2-a]pyrimidin-4-one
2-(8-cyclopropyl-2-methylimidazo[1,2-a]pyridin-6-yl)-7-[(3R,5S)-3,5-dimethylpiperazin-1-yl]-4H-pyrido[1,2-a]pyrimidin-4-one
7-(1-cyclopropylpiperidin-4-yl)-9-methyl-2-(2-methyl-2H-indazol-5-yl)-4H-pyrido[1,2-a]pyrimidin-4-one
7-(1-ethylpiperidin-4-yl)-9-methyl-2-(2-methyl-2H-indazol-5-yl)-4H-pyrido[1,2-a]pyrimidin-4-one
2-(4,6-dimethylpyrazolo[1,5-a]pyrazin-2-yl)-9-methyl-7-(piperazin-1-yl)-4H-pyrido[1,2-a]pyrimidin-4-one
9-methyl-2-(2-methyl-2H-indazol-5-yl)-7-(piperidin-4-yl)-4H-pyrido[1,2-a]pyrimidin-4-one
2-(4,6-dimethylpyrazolo[1,5-a]pyrazin-2-yl)-7-[(1-methylpiperidin-4-yl)oxy]-4H-pyrido[1,2-a]pyrimidin-4-one
2-(6-methyl-4-propylpyrazolo[1,5-a]pyrazin-2-yl)-7-(piperazin-1-yl)-4H-pyrido[1,2-a]pyrimidin-4-one
7-(4-methylpiperazin-1-yl)-2-(6-methyl-4-propylpyrazolo[1,5-a]pyrazin-2-yl)-4H-pyrido[1,2-a]pyrimidin-4-one
7-(4-ethylpiperazin-1-yl)-2-(6-methyl-4-propylpyrazolo[1,5-a]pyrazin-2-yl)-4H-pyrido[1,2-a]pyrimidin-4-one
7-[4-(2-hydroxyethyl)piperazin-1-yl]-2-(6-methyl-4-propylpyrazolo[1,5-a]pyrazin-2-yl)-4H-pyrido[1,2-a]pyrimidin-4-one
7-[(3R)-3-methylpiperazin-1-yl]-2-(6-methyl-4-propylpyrazolo[1,5-a]pyrazin-2-yl)-4H-pyrido[1,2-a]pyrimidin-4-one
7-[(3S)-3-methylpiperazin-1-yl]-2-(6-methyl-4-propylpyrazolo[1,5-a]pyrazin-2-yl)-4H-pyrido[1,2-a]pyrimidin-4-one
7-[(3R,5S)-3,5-dimethylpiperazin-1-yl]-2-(6-methyl-4-propylpyrazolo[1,5-a]pyrazin-2-yl)-4H-pyrido[1,2-a]pyrimidin-4-one
2-(1,3-dimethylpyrrolo[1,2-a]pyrazin-7-yl)-7-[(3R)-3-methyl-4-(propan-2-yl)piperazin-1-yl]-4H-pyrido[1,2-a]pyrimidin-4-one
7-(4-amino-4-methylpiperidin-1-yl)-2-(1,3-dimethylpyrrolo[1,2-a]pyrazin-7-yl)-4H-pyrido[1,2-a]pyrimidin-4-one
2-(4,6-dimethylpyrazolo[1,5-a]pyrazin-2-yl)-7-[(3S)-3-ethylpiperazin-1-yl]-9-methyl-4H-pyrido[1,2-a]pyrimidin-4-one
2-[2-methyl-8-(trifluoromethyl)imidazo[1,2-a]pyridin-6-yl]-7-(piperazin-1-yl)-4H-pyrido[1,2-a]pyrimidin-4-one
7-[(3R)-3-methylpiperazin-1-yl]-2-[2-methyl-8-(trifluoromethyl)imidazo[1,2-a]pyridin-6-yl]-4H-pyrido[1,2-a]pyrimidin-4-one
7-[(3S)-3-methylpiperazin-1-yl]-2-[2-methyl-8-(trifluoromethyl)imidazo[1,2-a]pyridin-6-yl]-4H-pyrido[1,2-a]pyrimidin-4-one
7-[(3R,5S)-3,5-dimethylpiperazin-1-yl]-2-[2-methyl-8-(trifluoromethyl)imidazo[1,2-a]pyridin-6-yl]-4H-pyrido[1,2-a]pyrimidin-4-one
7-(4-amino-4-methylpiperidin-1-yl)-2-(4-ethyl-6-methylpyrazolo[1,5-a]pyrazin-2-yl)-4H-pyrido[1,2-a]pyrimidin-4-one
2-(2,7-dimethyl-2H-indazol-5-yl)-7-(piperazin-1-yl)-4H-pyrido[1,2-a]pyrimidin-4-one
2-(2,7-dimethyl-2H-indazol-5-yl)-7-(piperidin-4-yl)-4H-pyrido[1,2-a]pyrimidin-4-one
7-(3-aminoprop-1-yn-1-yl)-2-(4,6-dimethylpyrazolo[1,5-a]pyrazin-2-yl)-4H-pyrido[1,2-a]pyrimidin-4-one
2-(2,7-dimethyl-2H-indazol-5-yl)-7-[(3R)-3-methylpiperazin-1-yl]-4H-pyrido[1,2-a]pyrimidin-4-one
7-(3-aminopropyl)-2-(4,6-dimethylpyrazolo[1,5-a]pyrazin-2-yl)-4H-pyrido[1,2-a]pyrimidin-4-one 2-(1,3-dimethylpyrrolo[1,2-a]pyrazin-7-yl)-7-(1,2,3,6-tetrahydropyridin-4-yl)-4H-pyrido[1,2-a]pyrimidin-4-one 2-(4,6-dimethylpyrazolo[1,5-a]pyrazin-2-yl)-7-(2,2,6,6-tetramethyl-1,2,3,6-tetrahydropyridin-4-yl)-4H-pyrido[1,2-a]pyrimidin-4-one 2-(4-ethyl-6-methylpyrazolo[1,5-a]pyrazin-2-yl)-7-(2,2,6,6-tetramethyl-1,2,3,6-tetrahydropyridin-4-yl)-4H-pyrido[1,2-a]pyrimidin-4-one 2-(4,6-dimethylpyrazolo[1,5-a]pyrazin-2-yl)-7-[(3aR,6aS)-hexahydropyrrolo[3,4-c]pyrrol-2(1H)-yl]-4H-pyrido[1,2-a]pyrimidin-4-one 2-(4-ethyl-6-methylpyrazolo[1,5-a]pyrazin-2-yl)-7-[(3aR,6aS)-hexahydropyrrolo[3,4-c]pyrrol-2(1H)-yl]-4H-pyrido[1,2-a]pyrimidin-4-one 7-[(3R,5S)-3,5-dimethylpiperazin-1-yl]-2-(1-ethyl-3-methylpyrrolo[1,2-a]pyrazin-7-yl)-4H-pyrido[1,2-a]pyrimidin-4-one 7-(1,4-diazepan-1-yl)-2-(1-ethyl-3-methylpyrrolo[1,2-a]pyrazin-7-yl)-4H-pyrido[1,2-a]pyrimidin-4-one 2-(2,7-dimethyl-2H-indazol-5-yl)-7-[(3S)-3-methylpiperazin-1-yl]-4H-pyrido[1,2-a]pyrimidin-4-one 2-(2,7-dimethyl-2H-indazol-5-yl)-7-[(3S)-3,4-dimethylpiperazin-1-yl]-4H-pyrido[1,2-a]pyrimidin-4-one 2-(2,7-dimethyl-2H-indazol-5-yl)-7-(1-methylpiperidin-4-yl)-4H-pyrido[1,2-a]pyrimidin-4-one 2-(2,7-dimethyl-2H-indazol-5-yl)-7-(1-ethylpiperidin-4-yl)-4H-pyrido[1,2-a]pyrimidin-4-one 9-methyl-2-(2-methyl-2H-indazol-5-yl)-7-(piperazin-1-yl)-4H-pyrido[1,2-a]pyrimidin-4-one 9-methyl-2-(2-methyl-2H-indazol-5-yl)-7-[(3R)-3-methylpiperazin-1-yl]-4H-pyrido[1,2-a]pyrimidin-4-one 9-methyl-2-(2-methyl-2H-indazol-5-yl)-7-[(3S)-3-methylpiperazin-1-yl]-4H-pyrido[1,2-a]pyrimidin-4-one 7-[3-(dimethylamino)azetidin-1-yl]-2-(4,6-dimethylpyrazolo[1,5-a]pyrazin-2-yl)-4H-pyrido[1,2-a]pyrimidin-4-one 7-[3-(diethylamino)azetidin-1-yl]-2-(4,6-dimethylpyrazolo[1,5-a]pyrazin-2-yl)-4H-pyrido[1,2-a]pyrimidin-4-one 2-(4,6-dimethylpyrazolo[1,5-a]pyrazin-2-yl)-7-[3-(pyrrolidin-1-yl)azetidin-1-yl]-4H-pyrido[1,2-a]pyrimidin-4-one 7-(1,4-diazepan-1-yl)-2-(4-ethyl-6-methylpyrazolo[1,5-a]pyrazin-2-yl)-4H-pyrido[1,2-a]pyrimidin-4-one 7-[(3aR,6aS)-hexahydropyrrolo[3,4-c]pyrrol-2(1H)-yl]-2-(6-methyl-4-propylpyrazolo[1,5-a]pyrazin-2-yl)-4H-pyrido[1,2-a]pyrimidin-4-one 2-(6-methyl-4-propylpyrazolo[1,5-a]pyrazin-2-yl)-7-(1,2,3,6-tetrahydropyridin-4-yl)-4H-pyrido[1,2-a]pyrimidin-4-one 2-(4-ethyl-6-methylpyrazolo[1,5-a]pyrazin-2-yl)-7-(1,2,3,6-tetrahydropyridin-4-yl)-4H-pyrido[1,2-a]pyrimidin-4-one 7-[(3S)-3-(aminomethyl)pyrrolidin-1-yl]-2-(4,6-dimethylpyrazolo[1,5-a]pyrazin-2-yl)-4H-pyrido[1,2-a]pyrimidin-4-one 2-(4,6-dimethylpyrazolo[1,5-a]pyrazin-2-yl)-7-[3-(piperidin-1-yl)azetidin-1-yl]-4H-pyrido[1,2-a]pyrimidin-4-one 2-(6-methyl-4-propylpyrazolo[1,5-a]pyrazin-2-yl)-7-(piperidin-4-yl)-4H-pyrido[1,2-a]pyrimidin-4-one 7-(2,7-diazaspiro[4.4]non-2-yl)-2-(4,6-dimethylpyrazolo[1,5-a]pyrazin-2-yl)-4H-pyrido[1,2-a]pyrimidin-4-one 2-(2,7-dimethyl-2H-indazol-5-yl)-7-(4-methylpiperazin-1-yl)-4H-pyrido[1,2-a]pyrimidin-4-one 7-[3-(dimethylamino)propyl]-2-(4,6-dimethylpyrazolo[1,5-a]pyrazin-2-yl)-4H-pyrido[1,2-a]pyrimidin-4-one 7-{(3S)-3-[(dimethylamino)methyl]pyrrolidin-1-yl}-2-(4,6-dimethylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-9-methyl-7-(piperidin-4-yl)-4H-pyrido[1,2-a]pyrimidin-4-one 9-methyl-2-(1-methyl-1H-indazol-5-yl)-7-(piperidin-4-yl)-4H-pyrido[1,2-a]pyrimidin-4-one 2-(4-ethyl-6-methylpyrazolo[1,5-a]pyrazin-2-yl)-9-methyl-7-(1,2,3,6-tetrahydropyridin-4-yl)-4H-pyrido[1,2-a]pyrimidin-4-one 2-(4-ethyl-6-methylpyrazolo[1,5-a]pyrazin-2-yl)-9-methyl-7-(1-methylpiperidin-4-yl)-4H-pyrido[1,2-a]pyrimidin-4-one 2-(1,7-dimethyl-1H-indazol-5-yl)-7-(piperidin-4-yl)-4H-pyrido[1,2-a]pyrimidin-4-one 2-(1,7-dimethyl-1H-indazol-5-yl)-7-(piperazin-1-yl)-4H-pyrido[1,2-a]pyrimidin-4-one 2-(1,7-dimethyl-1H-indazol-5-yl)-7-[(3S)-3-methylpiperazin-1-yl]-4H-pyrido[1,2-a]pyrimidin-4-one 7-{(3S)-3-[(diethylamino)methyl]pyrrolidin-1-yl}-2-(4,6-dimethylpyrazolo[1,5-a]pyrazin-2-yl)-4H-pyrido[1,2-a]pyrimidin-4-one 2-(4,6-dimethylpyrazolo[1,5-a]pyrazin-2-yl)-7-{(3S)-3-[(ethylamino)methyl]pyrrolidin-1-yl}-4H-pyrido[1,2-a]pyrimidin-4-one 7-{3-[(dimethylamino)methyl]azetidin-1-yl}-2-(4,6-dimethylpyrazolo[1,5-a]pyrazin-2-yl)-4H-pyrido[1,2-a]pyrimidin-4-one 7-{3-[(diethylamino)methyl]azetidin-1-yl}-2-(4,6-dimethylpyrazolo[1,5-a]pyrazin-2-yl)-4H-pyrido[1,2-a]pyrimidin-4-one 2-(1-ethyl-3-methylpyrrolo[1,2-a]pyrazin-7-yl)-7-[(8aS)-hexahydropyrrolo[1,2-a]pyrazin-2(1H)-yl]-4H-pyrido[1,2-a]pyrimidin-4-one 2-(4-ethyl-6-methylpyrazolo[1,5-a]pyrazin-2-yl)-9-methyl-7-[(3R)-3-methylpiperazin-1-yl]-4H-pyrido[1,2-a]pyrimidin-4-one 9-methyl-2-(1-methyl-1H-indazol-5-yl)-7-(1-methylpiperidin-4-yl)-4H-pyrido[1,2-a]pyrimidin-4-one 7-[(3R)-3,4-dimethylpiperazin-1-yl]-2-(4-ethyl-6-methylpyrazolo[1,5-a]pyrazin-2-yl)-9-methyl-4H-pyrido[1,2-a]pyrimidin-4-one 7-(1-ethylpiperidin-4-yl)-9-methyl-2-(1-methyl-1H-indazol-5-yl)-4H-pyrido[1,2-a]pyrimidin-4-one 2-(4-ethyl-6-methylpyrazolo[1,5-a]pyrazin-2-yl)-9-methyl-7-[(3S)-3-methylpiperazin-1-yl]-4H-pyrido[1,2-a]pyrimidin-4-one 7-[1-(2-hydroxyethyl)piperidin-4-yl]-9-methyl-2-(1-methyl-1H-indazol-5-yl)-4H-pyrido[1,2-a]pyrimidin-4-one 7-[(3S)-3,4-dimethylpiperazin-1-yl]-2-(4-ethyl-6-methylpyrazolo[1,5-a]pyrazin-2-yl)-9-methyl-4H-pyrido[1,2-a]pyrimidin-4-one 2-(4-ethyl-6-methylpyrazolo[1,5-a]pyrazin-2-yl)-7-(1-ethylpiperidin-4-yl)-9-methyl-4H-pyrido[1,2-a]pyrimidin-4-one 9-methyl-2-(2-methyl-2H-indazol-5-yl)-7-(1,2,3,6-tetrahydropyridin-4-yl)-4H-pyrazino[1,2-a]pyrimidin-4-one 7-(1-cyclobutylpiperidin-4-yl)-2-(4-ethyl-6-methylpyrazolo[1,5-a]pyrazin-2-yl)-9-methyl-4H-pyrido[1,2-a]pyrimidin-4-one 2-(4-ethyl-6-methylpyrazolo[1,5-a]pyrazin-2-yl)-7-[1-(2-hydroxyethyl)piperidin-4-yl]-9-methyl-4H-pyrido[1,2-a]pyrimidin-4-one 2-(8-ethyl-2-methylimidazo[1,2-a]pyridin-6-yl)-7-[(8aR)-hexahydropyrrolo[1,2-a]pyrazin-2(1H)-yl]-4H-pyrido[1,2-a]pyrimidin-4-one 2-(8-ethyl-2-methylimidazo[1,2-a]pyridin-6-yl)-7-[(8aS)-hexahydropyrrolo[1,2-a]pyrazin-2(1H)-yl]-4H-pyrido[1,2-a]pyrimidin-4-one 9-methyl-2-(2-methyl-2H-indazol-5-yl)-7-(piperidin-4-yl)-4H-pyrazino[1,2-a]pyrimidin-4-one 7-[(3R)-3-(aminomethyl)pyrrolidin-1-yl]-2-(4,6-dimethylpyrazolo[1,5-a]pyrazin-2-yl)-4H-pyrido[1,2-a]pyrimidin-4-one 2-(4,6-dimethylpyrazolo[1,5-a]pyrazin-2-yl)-7-[(2S,6S)-2,6-dimethyl-1,2,3,6-tetrahydropyridin-4-yl]-4H-pyrido[1,2-a]pyrimidin-4-one 7-{(3R)-3-[(dimethylamino)methyl]pyrrolidin-1-yl}-2-(4,6-dimethylpyrazolo[1,5-a]pyrazin-2-yl)-4H-pyrido[1,2-a]pyrimidin-4-one 7-[(2S,6S)-2,6-dimethylpiperidin-4-yl]-2-(4,6-dimethylpyrazolo[1,5-a]pyrazin-2-yl)-4H-pyrido[1,2-a]pyrimidin-4-one 2-(8-fluoro-2-methylimidazo[1,2-a]pyridin-6-yl)-7-[4-(2-hydroxyethyl)piperazin-1-yl]-4H-pyrido[1,2-a]pyrimidin-4-one 2-(imidazo[1,2-a]pyridin-6-yl)-7-(4-methylpiperazin-1-yl)-4H-pyrido[1,2-a]pyrimidin-4-one 2-(4-fluoro-2-methyl-1,3-benzoxazol-6-yl)-7-[(8aS)-hexahydropyrrolo[1,2-a]pyrazin-2(1H)-yl]-4H-pyrido[1,2-a]pyrimidin-4-one 7-(2,7-diazaspiro[3.5]non-7-yl)-2-(4,6-dimethylpyrazolo[1,5-a]pyrazin-2-yl)-4H-pyrido[1,2-a]pyrimidin-4-one 7-(4-methylpiperazin-1-yl)-2-(2-methyl[1,2,4]triazolo[1,5-a]pyridin-6-yl)-4H-pyrido[1,2-a]pyrimidin-4-one 7-(4-methylpiperazin-1-yl)-2-[2-methyl-8-(trifluoromethyl)imidazo[1,2-a]pyridin-6-yl]-4H-pyrido[1,2-a]pyrimidin-4-one 2-methyl-6-[7-(4-methylpiperazin-1-yl)-4-oxo-4H-pyrido[1,2-a]pyrimidin-2-yl]imidazo[1,2-a]pyridine-8-carbonitrile 2-(2,8-dimethylimidazo[1,2-a]pyridin-6-yl)-7-(4-methylpiperazin-1-yl)-4H-pyrido[1,2-a]pyrimidin-4-one 7-(4,7-diazaspiro[2.5]oct-7-yl)-2-(2,8-dimethylimidazo[1,2-a]pyridin-6-yl)-4H-pyrido[1,2-a]pyrimidin-4-one 2-(8-fluoro-2-methylimidazo[1,2-a]pyridin-6-yl)-7-(1-methylpiperidin-4-yl)-4H-pyrido[1,2-a]pyrimidin-4-one 2-(8-fluoro-2-methylimidazo[1,2-a]pyridin-6-yl)-7-(4-hydroxypiperidin-4-yl)-4H-pyrido[1,2-a]pyrimidin-4-one 2-(4-ethyl-6-methylpyrazolo[1,5-a]pyrazin-2-yl)-7-[(8aS)-hexahydropyrrolo[1,2-a]pyrazin-2(1H)-yl]-4H-pyrido[1,2-a]pyrimidin-4-one 2-(4-ethyl-6-methylpyrazolo[1,5-a]pyrazin-2-yl)-7-[(8aR)-hexahydropyrrolo[1,2-a]pyrazin-2(1H)-yl]-4H-pyrido[1,2-a]pyrimidin-4-one 7-[(3R)-3-(dimethylamino)pyrrolidin-1-yl]-2-(4-ethyl-6-methylpyrazolo[1,5-a]pyrazin-2-yl)-4H-pyrido[1,2-a]pyrimidin-4-one 7-[(3S)-3-(dimethylamino)pyrrolidin-1-yl]-2-(4-ethyl-6-methylpyrazolo[1,5-a]pyrazin-2-yl)-4H-pyrido[1,2-a]pyrimidin-4-one 2-(8-fluoro-2-methylimidazo[1,2-a]pyridin-6-yl)-7-[(8aS)-8a-methylhexahydropyrrolo[1,2-a]pyrazin-2(1H)-yl]-4H-pyrido[1,2-a]pyrimidin-4-one 2-(4-ethyl-6-methylpyrazolo[1,5-a]pyrazin-2-yl)-7-(4-ethylpiperazin-1-yl)-9-methyl-4H-pyrido[1,2-a]pyrimidin-4-one 2-(4-ethyl-6-methylpyrazolo[1,5-a]pyrazin-2-yl)-7-[(8aS)-hexahydropyrrolo[1,2-a]pyrazin-2(1H)-yl]-9-methyl-4H-pyrido[1,2-a]pyrimidin-4-one 2-(2,8-dimethylimidazo[1,2-a]pyridin-6-yl)-7-(4-ethylpiperazin-1-yl)-4H-pyrido[1,2-a]pyrimidin-4-one 2-(2,8-dimethylimidazo[1,2-a]pyridin-6-yl)-7-[(8aS)-hexahydropyrrolo[1,2-a]pyrazin-2(1H)-yl]-4H-pyrido[1,2-a]pyrimidin-4-one 2-(2,8-dimethylimidazo[1,2-a]pyridin-6-yl)-7-(8a-methylhexahydropyrrolo[1,2-a]pyrazin-2(1H)-yl)-4H-pyrido[1,2-a]pyrimidin-4-one 7-[(3R)-3-(dimethylamino)pyrrolidin-1-yl]-2-(4-ethyl-6-methylpyrazolo[1,5-a]pyrazin-2-yl)-9-methyl-4H-pyrido[1,2-a]pyrimidin-4-one 2-(4-ethyl-6-methylpyrazolo[1,5-a]pyrazin-2-yl)-7-{[2-(morpholin-4-yl)ethyl]amino}-4H-pyrido[1,2-a]pyrimidin-4-one 7-{[2-(dimethylamino)ethyl]amino}-2-(4-ethyl-6-methylpyrazolo[1,5-a]pyrazin-2-yl)-4H-pyrido[1,2-a]pyrimidin-4-one 7-{[2-(dimethylamino)ethyl](methyl)amino}-2-(4-ethyl-6-methylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-7-{methyl[2-(methylamino)ethyl]amino}-4H-pyrido[1,2-a]pyrimidin-4-one 7-[(3R)-3-(dimethylamino)pyrrolidin-1-yl]-2-(2,8-dimethylimidazo[1,2-a]pyridin-6-yl)-4H-pyrido[1,2-a]pyrimidin-4-one 7-[(3S)-3-(dimethylamino)pyrrolidin-1-yl]-2-(2,8-dimethylimidazo[1,2-a]pyridin-6-yl)-4H-pyrido[1,2-a]pyrimidin-4-one 7-[2-(dimethylamino)ethoxy]-2-(4-ethyl-6-methylpyrazolo[1,5-a]pyrazin-2-yl)-9-methyl-4H-pyrido[1,2-a]pyrimidin-4-one 7-[2-(dimethylamino)ethoxy]-2-(4-ethyl-6-methylpyrazolo[1,5-a]pyrazin-2-yl)-4H-pyrido[1,2-a]pyrimidin-4-one 2-(4-ethyl-6-methylpyrazolo[1,5-a]pyrazin-2-yl)-7-(piperidin-4-ylmethoxy)-4H-pyrido[1,2-a]pyrimidin-4-one 2-(4-ethyl-6-methylpyrazolo[1,5-a]pyrazin-2-yl)-7-[2-(piperidin-1-yl)ethoxy]-4H-pyrido[1,2-a]pyrimidin-4-one 2-(4-ethyl-6-methylpyrazolo[1,5-a]pyrazin-2-yl)-7-[3-(morpholin-4-yl)propoxy]-4H-pyrido[1,2-a]pyrimidin-4-one 7-[3-(dimethylamino)propoxy]-2-(4-ethyl-6-methylpyrazolo[1,5-a]pyrazin-2-yl)-4H-pyrido[1,2-a]pyrimidin-4-one, or 2-(4,6-dimethylpyrazolo[1,5-a]pyrazin-2-yl)-7-[(3aR,6aS)-5-methylhexahydropyrrolo[3,4-a]pyrrol-2(1H)-yl]-4H-pyrido[1,2-a]pyrimidin-4-one or a salt, isotopologue, stereoisomer, racemate, enantiomer, diastereomer or tautomer thereof.

In another embodiment, the compound of Formula (I) used in a method disclosed herein is a compound selected from the group consisting of:

2-(3,5-difluoro-4-hydroxyphenyl)-7-(piperazin-1-yl)-4H-pyrido[1,2-a]pyrimidin-4-one hydrochloride 7-[4-(dimethylamino)piperidin-1-yl]-2-(3-fluoro-4-methoxyphenyl)-4H-quinolizin-4-one acetate 2-(2-methyl-1,3-benzothiazol-6-yl)-7-(piperidin-4-yl)-4H-pyrimido[1,2-b]pyridazin-4-one trifluoroacetate (1:1), or 2-(1,3-dimethylpyrrolo[1,2-a]pyrazin-7-yl)-7-(1,2,3,6-tetrahydropyridin-4-yl)-4H-pyrazino[1,2-a]pyrimidin-4-one hydrochloride (1:2)

or a free base, isotopologue, stereoisomer, racemate, enantiomer, diastereomer or tautomer thereof.

Compounds of Formula (I) can be prepared using reagents and methods known in the art, including the methods provided in International Application No. PCT/US2013/025292, filed on Feb. 8, 2013, and published as International Publication No. WO 2013/119916 on Aug. 15, 2013, the entire contents which are incorporated herein by reference (see in particular, General Synthetic Methods, Schemes A-J, at paragraphs [001126] to [001159]; and Specific Synthetic Examples, at paragraphs [001160] to [001573] and Table 1, therein).

Terminology

The chemical terms used above and throughout the description herein, unless specifically defined otherwise, shall be understood by one of ordinary skill in the art to have the following indicated meanings.

As used herein, the term "$C_{1-8}$alkyl" generally refers to saturated hydrocarbon radicals having from one to eight carbon atoms in a straight or branched chain configuration, including, but not limited to, methyl, ethyl, n-propyl (also referred to as propyl or propanyl), isopropyl, n-butyl (also referred to as butyl or butanyl), isobutyl, sec-butyl, tert-butyl, n-pentyl (also referred to as pentyl or pentanyl), n-hexyl (also referred to as hexyl or hexanyl), n-heptyl (also referred to as heptyl or heptanyl), n-octyl and the like. In some embodiments, $C_{1-8}$alkyl includes, but is not limited to, $C_{1-6}$alkyl, $C_{1-4}$alkyl and the like. A $C_{1-8}$alkyl radical is optionally substituted with substituent species as described herein where allowed by available valences.

As used herein, the term "$C_{2-8}$alkenyl" generally refers to partially unsaturated hydrocarbon radicals having from two to eight carbon atoms in a straight or branched chain configuration and one or more carbon-carbon double bonds therein, including, but not limited to, ethenyl (also referred to as vinyl), allyl, propenyl and the like. In some embodiments, $C_{2-8}$alkenyl includes, but is not limited to, $C_{2-6}$alkenyl, $C_{2-4}$alkenyl and the like. A $C_{2-8}$alkenyl radical is optionally substituted with substituent species as described herein where allowed by available valences.

As used herein, the term "$C_{2-8}$alkynyl" generally refers to partially unsaturated hydrocarbon radicals having from two to eight carbon atoms in a straight or branched chain configuration and one or more carbon-carbon triple bonds therein, including, but not limited to, ethynyl, propynyl, butynyl and the like. In some embodiments, $C_{2-8}$alkynyl includes, but is not limited to, $C_{2-6}$alkynyl, $C_{2-4}$alkynyl and the like. A $C_{2-8}$alkynyl radical is optionally substituted with substituent species as described herein where allowed by available valences.

As used herein, the term "$C_{1-8}$alkoxy" generally refers to saturated hydrocarbon radicals having from one to eight carbon atoms in a straight or branched chain configuration of the formula: —O—$C_{1-8}$alkyl, including, but not limited to, methoxy, ethoxy, n-propoxy, isopropoxy, n-butoxy, isobutoxy, sec-butoxy, tert-butoxy, n-pentoxy, n-hexoxy and the like. In some embodiments, $C_{1-8}$alkoxy includes, but is not limited to, $C_{1-6}$alkoxy, $C_{1-4}$alkoxy and the like. A $C_{1-8}$alkoxy radical is optionally substituted with substituent species as described herein where allowed by available valences.

As used herein, the term "$C_{3-14}$cycloalkyl" generally refers to a saturated or partially unsaturated monocyclic, bicyclic or polycyclic hydrocarbon radical, including, but not limited to, cyclopropyl, cyclobutyl, cyclopentyl, cyclohexyl, cyclohexenyl, cycloheptyl, cyclooctyl, 1H-indanyl, indenyl, tetrahydro-naphthalenyl and the like. In some embodiments, $C_{3-14}$cycloalkyl includes, but is not limited to, $C_{3-8}$cycloalkyl, $C_{5-8}$cycloalkyl, $C_{3-10}$cycloalkyl and the like. A $C_{3-14}$cycloalkyl radical is optionally substituted with substituent species as described herein where allowed by available valences.

As used herein, the term "aryl" generally refers to a monocyclic, bicyclic or polycyclic aromatic carbon atom ring structure radical, including, but not limited to, phenyl, naphthyl, anthracenyl, fluorenyl, azulenyl, phenanthrenyl and the like. An aryl radical is optionally substituted with substituent species as described herein where allowed by available valences.

As used herein, the term "heteroaryl" generally refers to a monocyclic, bicyclic or polycyclic aromatic carbon atom ring structure radical in which one or more carbon atom ring members have been replaced, where allowed by structural stability, with one or more heteroatoms, such as an O, S or N atom, including, but not limited to, furanyl (also referred to as furyl), thienyl (also referred to as thiophenyl), pyrrolyl, 2H-pyrrolyl, 3H-pyrrolyl, pyrazolyl, 1H-pyrazolyl, imidazolyl, 1H-imidazolyl, isoxazolyl, isothiazolyl, oxazolyl, 1,3-thiazolyl, triazolyl (such as 1H-1,2,3-triazolyl and the like), oxadiazolyl (such as 1,2,4-oxadiazolyl, 1,3,4-oxadiazolyl and the like), thiadiazolyl, tetrazolyl (such as 1H-tetrazolyl, 2H-tetrazolyl and the like), pyridinyl (also referred to as pyridyl), pyrimidinyl, pyrazinyl, pyridazinyl, triazinyl, indolyl, 1H-indolyl, indazolyl, 1H-indazolyl, 2H-indazolyl, indolizinyl, isoindolyl, benzofuranyl, benzothienyl (also referred to as benzothiophenyl), benzoimidazolyl, 1H-benzoimidazolyl, 1,3-benzothiazolyl, 1,3-benzoxazolyl (also referred to as 1,3-benzooxazolyl), purinyl, 9H-purinyl, quinolinyl, isoquinolinyl, quinazolinyl, quinoxalinyl, 1,3-diazinyl, 1,2-diazinyl, 1,2-diazolyl, 1,4-diazanaphthalenyl, acridinyl, furo[3,2-b]pyridinyl, furo[3,2-c]pyridinyl, furo[2,3-c]pyridinyl, 6H-thieno[2,3-b]pyrrolyl, thieno[3,2-c]pyridinyl, thieno[2,3-d]pyrimidinyl, 1H-pyrrolo[2,3-b]pyridinyl, 1H-pyrrolo[2,3-c]pyridinyl, 1H-pyrrolo[3,2-b]pyridinyl, pyrrolo[1,2-a]pyrazinyl, pyrrolo[1,2-b]pyridazinyl, pyrazolo[1,5-a]pyridinyl, pyrazolo[1,5-a]pyrazinyl, imidazo[1,2-a]pyridinyl, 3H-imidazo[4,5-b]pyridinyl, imidazo[1,2-a]pyrimidinyl, imidazo[1,2-c]pyrimidinyl, imidazo[1,2-b]pyridazinyl, imidazo[1,2-a]pyrazinyl, imidazo[2,1-b][1,3]thiazolyl, imidazo[2,1-b][1,3,4]thiadiazolyl, [1,2,4]triazolo[1,5-a]pyridinyl, [1,2,4]triazolo[4,3-a]pyridinyl and the like. A heteroaryl radical is optionally substituted on a carbon or nitrogen atom ring member with substituent species as described herein where allowed by available valences.

As used herein, the term "heterocyclyl" generally refers to a saturated or partially unsaturated monocyclic, bicyclic or polycyclic carbon atom ring structure radical in which one or more carbon atom ring members have been replaced, where allowed by structural stability, with a heteroatom, such as an O, S or N atom, including, but not limited to, oxiranyl, oxetanyl, azetidinyl, tetrahydrofuranyl, pyrrolinyl, pyrrolidinyl, pyrazolinyl, pyrazolidinyl, imidazolinyl, imidazolidinyl, isoxazolinyl, isoxazolidinyl, isothiazolinyl, isothiazolidinyl, oxazolinyl, oxazolidinyl, thiazolinyl, thiazolidinyl, triazolinyl, triazolidinyl, oxadiazolinyl, oxadiazolidinyl, thiadiazolinyl, thiadiazolidinyl, tetrazolinyl, tetrazolidinyl, pyranyl, dihydro-2H-pyranyl, thiopyranyl, 1,3-dioxanyl, 1,2,5,6-tetrahydropyridinyl, 1,2,3,6-tetrahydropyridinyl, piperidinyl, piperazinyl, morpholinyl, thiomorpholinyl, 1,4-diazepanyl, 1,3-benzodioxolyl (also referred to as benzo[d][1,3]dioxolyl), 1,4-benzodioxanyl, 2,3-dihydro-1,4-benzodioxinyl (also referred to as 2,3-dihydrobenzo[b][1,4]dioxinyl), hexahydropyrrolo[3,4-b]pyrrol-(1H)-yl, (3aS,6aS)-hexahydropyrrolo[3,4-b]pyrrol-(1H)-yl, (3aR,6aR)-hexahydropyrrolo[3,4-b]pyrrol-(1H)-yl, hexahydropyrrolo[3,4-b]pyrrol-(2H)-yl, (3aS,6aS)-hexahydropyrrolo[3,4-b]pyrrol-(2H)-yl, (3aR,6aR)-hexahydropyrrolo[3,4-b]pyrrol-(2H)-yl, hexahydropyrrolo[3,4-c]pyrrol-(1H)-yl, (3aR,6aS)-hexahydropyrrolo[3,4-c]pyrrol-(1H)-yl, (3aR,6aR)-hexahydropyrrolo[3,4-c]pyrrol-(1H)-yl, octahydro-5H-pyrrolo[3,2-c]pyridinyl, octahydro-6H-pyrrolo[3,4-b]pyridinyl, (4aR,7aR)-octahydro-6H-pyrrolo[3,4-b]pyridinyl, (4aS,7aS)-octahydro-6H-pyrrolo[3,4-b]pyridinyl, hexahydropyrrolo[1,2-a]pyrazin-(1H)-yl, (7R,8aS)-hexahydropyrrolo[1,2-a]pyrazin-(1H)-yl, (8aS)-hexahydropyrrolo

[1,2-a]pyrazin-(1H)-yl, (8aR)-hexahydropyrrolo[1,2-a]pyrazin-(1H)-yl, (8aS)-octahydropyrrolo[1,2-a]pyrazin-(1H)-yl, (8aR)-octahydropyrrolo[1,2-a]pyrazin-(1H)-yl, hexahydropyrrolo[1,2-a]pyrazin-(2H)-one, octahydro-2H-pyrido[1,2-a]pyrazinyl, 3-azabicyclo[3.1.0]hexyl, (1R,5S)-3-azabicyclo[3.1.0]hexyl, 8-azabicyclo[3.2.1]octyl, (1R,5S)-8-azabicyclo[3.2.1]octyl, 8-azabicyclo[3.2.1]oct-2-enyl, (1R,5S)-8-azabicyclo[3.2.1]oct-2-enyl, 9-azabicyclo[3.3.1]nonyl, (1R,5S)-9-azabicyclo[3.3.1]nonyl, 2,5-diazabicyclo[2.2.1]heptyl, (1S,4S)-2,5-diazabicyclo[2.2.1]heptyl, 2,5-diazabicyclo[2.2.2]octyl, 3,8-diazabicyclo[3.2.1]octyl, (1R,5S)-3,8-diazabicyclo[3.2.1]octyl, 1,4-diazabicyclo[3.2.2]nonyl, azaspiro[3.3]heptyl, 2,6-diazaspiro[3.3]heptyl, 2,7-diazaspiro[3.5]nonyl, 5,8-diazaspiro[3.5]nonyl, 2,7-diazaspiro[4.4]nonyl, 6,9-diazaspiro[4.5]decyl and the like. A heterocyclyl radical is optionally substituted on a carbon or nitrogen atom ring member with substituent species as described herein where allowed by available valences.

As used herein, the term "$C_{1-8}$alkoxy-$C_{1-8}$alkyl" refers to a radical of the formula: —$C_{1-8}$alkyl-O—$C_{1-8}$alkyl.

As used herein, the term "$C_{1-8}$alkoxy-$C_{1-8}$alkyl-amino" refers to a radical of the formula: —NH—$C_{1-8}$alkyl-O—$C_{1-8}$alkyl.

As used herein, the term "($C_{1-8}$alkoxy-$C_{1-8}$alkyl)$_2$-amino" refers to a radical of the formula: —N($C_{1-8}$alkyl-O—$C_{1-8}$alkyl)$_2$.

As used herein, the term "$C_{1-8}$alkoxy-$C_{1-8}$alkyl-amino-$C_{1-8}$alkoxy" refers to a radical of the formula: —O—$C_{1-8}$alkyl-NH—$C_{1-8}$alkyl-O—$C_{1-8}$alkyl.

As used herein, the term "($C_{1-8}$alkoxy-$C_{1-8}$alkyl)$_2$-amino-$C_{1-8}$alkoxy" refers to a radical of the formula: —O—$C_{1-8}$alkyl-N($C_{1-8}$alkyl-O—$C_{1-8}$alkyl)$_2$.

As used herein, the term "($C_{1-8}$alkoxy-$C_{1-8}$alkyl)($C_{1-8}$alkyl)amino-$C_{1-8}$alkoxy" refers to a radical of the formula: —O—$C_{1-8}$alkyl-N($C_{1-8}$alkyl)($C_{1-8}$alkyl-O—$C_{1-8}$alkyl).

As used herein, the term "$C_{1-8}$alkoxy-$C_{1-8}$alkyl-amino-$C_{1-8}$alkyl" refers to a radical of the formula: —$C_{1-8}$alkyl-NH—$C_{1-8}$alkyl-O—$C_{1-8}$alkyl.

As used herein, the term "($C_{1-8}$alkoxy-$C_{1-8}$alkyl)$_2$-amino-$C_{1-8}$alkyl" refers to a radical of the formula: —$C_{1-8}$alkyl-N($C_{1-8}$alkyl-O—$C_{1-8}$alkyl)$_2$.

As used herein, the term "($C_{1-8}$alkoxy-$C_{1-8}$alkyl)($C_{1-8}$alkyl)amino-$C_{1-8}$alkyl" refers to a radical of the formula: —$C_{1-8}$alkyl-N($C_{1-8}$alkyl)($C_{1-8}$alkyl-O—$C_{1-8}$alkyl).

As used herein, the term "$C_{1-8}$alkoxy-carbonyl" refers to a radical of the formula: —C(O)—O—$C_{1-8}$alkyl.

As used herein, the term "$C_{1-8}$alkoxy-carbonyl-$C_{2-8}$alkenyl" refers to a radical of the formula: —$C_{2-8}$alkenyl-C(O)—O—$C_{1-8}$alkyl.

As used herein, the term "$C_{1-8}$alkoxy-carbonyl-amino" refers to a radical of the formula: —NH—C(O)—O—$C_{1-8}$alkyl.

As used herein, the term "$C_{1-8}$alkyl-amino" refers to a radical of the formula: —NH—$C_{1-8}$alkyl.

As used herein, the term "($C_{1-8}$alkyl)$_2$-amino" refers to a radical of the formula: —N($C_{1-8}$alkyl)$_2$.

As used herein, the term "$C_{1-8}$alkyl-amino-$C_{2-8}$alkenyl" refers to a radical of the formula: —$C_{2-8}$alkenyl-NH—$C_{1-8}$alkyl.

As used herein, the term "($C_{1-8}$alkyl)$_2$-amino-$C_{2-8}$alkenyl" refers to a radical of the formula: —$C_{2-8}$alkenyl-N($C_{1-8}$alkyl)$_2$.

As used herein, the term "$C_{1-8}$alkyl-amino-$C_{1-8}$alkoxy" refers to a radical of the formula: —O—$C_{1-8}$alkyl-NH—$C_{1-8}$alkyl.

As used herein, the term "($C_{1-8}$alkyl)$_2$-amino-$C_{1-8}$alkoxy" refers to a radical of the formula: —O—$C_{1-8}$alkyl-N($C_{1-8}$alkyl)$_2$.

As used herein, the term "$C_{1-8}$alkyl-amino-$C_{1-8}$alkyl" refers to a radical of the formula: —$C_{1-8}$alkyl-NH—$C_{1-8}$alkyl.

As used herein, the term "($C_{1-8}$alkyl)$_2$-amino-$C_{1-8}$alkyl" refers to a radical of the formula: —$C_{1-8}$alkyl-N($C_{1-8}$alkyl)$_2$.

As used herein, the term "$C_{1-8}$alkyl-amino-$C_{1-8}$alkyl-amino" refers to a radical of the formula: —NH—$C_{1-8}$alkyl-NH—$C_{1-8}$alkyl.

As used herein, the term "($C_{1-8}$alkyl)$_2$-amino-$C_{1-8}$alkyl-amino" refers to a radical of the formula: —NH—$C_{1-8}$alkyl-N($C_{1-8}$alkyl)$_2$.

As used herein, the term "($C_{1-8}$alkyl-amino-$C_{1-8}$alkyl)$_2$-amino" refers to a radical of the formula: —N($C_{1-8}$alkyl-NH—$C_{1-8}$alkyl)$_2$.

As used herein, the term "[($C_{1-8}$alkyl)$_2$-amino-$C_{1-8}$alkyl]$_2$-amino" refers to a radical of the formula: —N[$C_{1-8}$alkyl-N($C_{1-8}$alkyl)$_2$]$_2$.

As used herein, the term "($C_{1-8}$alkyl-amino-$C_{1-8}$alkyl)($C_{1-8}$alkyl)amino" refers to a radical of the formula: —N($C_{1-8}$alkyl)($C_{1-8}$alkyl-NH—$C_{1-8}$alkyl).

As used herein, the term "[($C_{1-8}$alkyl)$_2$-amino-$C_{1-8}$alkyl]($C_{1-8}$alkyl)amino" refers to a radical of the formula: —N($C_{1-8}$alkyl)[$C_{1-8}$alkyl-N($C_{1-8}$alkyl)$_2$].

As used herein, the term "$C_{1-8}$alkyl-amino-$C_{2-8}$alkynyl" refers to a radical of the formula: —$C_{2-8}$alkynyl-NH—$C_{1-8}$alkyl.

As used herein, the term "($C_{1-8}$alkyl)$_2$-amino-$C_{2-8}$alkynyl" refers to a radical of the formula: —$C_{2-8}$alkynyl-N($C_{1-8}$alkyl)$_2$.

As used herein, the term "$C_{1-8}$alkyl-carbonyl" refers to a radical of the formula: —C(O)—$C_{1-8}$alkyl.

As used herein, the term "$C_{1-8}$alkyl-carbonyl-amino" refers to a radical of the formula: —NH—C(O)—$C_{1-8}$alkyl.

As used herein, the term "$C_{1-8}$alkyl-thio" refers to a radical of the formula: —S—$C_{1-8}$alkyl.

As used herein, the term "amino-$C_{2-8}$alkenyl" refers to a radical of the formula: —$C_{2-8}$alkenyl-NH$_2$.

As used herein, the term "amino-$C_{1-8}$alkoxy" refers to a radical of the formula: —O—$C_{1-8}$alkyl-NH$_2$.

As used herein, the term "amino-$C_{1-8}$alkyl" refers to a radical of the formula: —$C_{1-8}$alkyl-NH$_2$.

As used herein, the term "amino-$C_{1-8}$alkyl-amino" refers to a radical of the formula: —NH—$C_{1-8}$alkyl-NH$_2$.

As used herein, the term "(amino-$C_{1-8}$alkyl)$_2$-amino" refers to a radical of the formula: —N($C_{1-8}$alkyl-NH$_2$)$_2$.

As used herein, the term "(amino-$C_{1-8}$alkyl)($C_{1-8}$alkyl)amino" refers to a radical of the formula: —N($C_{1-8}$alkyl)($C_{1-8}$alkyl-NH$_2$).

As used herein, the term "amino-$C_{2-8}$alkynyl" refers to a radical of the formula: —$C_{2-8}$alkynyl-NH$_2$.

As used herein, the term "aryl-$C_{1-8}$alkoxy-carbonyl" refers to a radical of the formula: —C(O)—O—$C_{1-8}$alkyl-aryl.

As used herein, the term "aryl-$C_{1-8}$alkyl" refers to a radical of the formula: —$C_{1-8}$alkyl-aryl.

As used herein, the term "aryl-$C_{1-8}$alkyl-amino" refers to a radical of the formula: —NH—$C_{1-8}$alkyl-aryl.

As used herein, the term "(aryl-$C_{1-8}$alkyl)$_2$-amino" refers to a radical of the formula: —N($C_{1-8}$alkyl-aryl)$_2$.

As used herein, the term "(aryl-$C_{1-8}$alkyl)($C_{1-8}$alkyl)amino" refers to a radical of the formula: —N($C_{1-8}$alkyl)($C_{1-8}$alkyl-aryl).

As used herein, the term "aryl-$C_{1-8}$alkyl-amino-$C_{1-8}$alkyl" refers to a radical of the formula: —$C_{1-8}$alkyl-NH—$C_{1-8}$alkyl-aryl.

As used herein, the term "(aryl-$C_{1-8}$alkyl)$_2$-amino-$C_{1-8}$alkyl" refers to a radical of the formula: —$C_{1-8}$alkyl-N($C_{1-8}$alkyl-aryl)$_2$.

As used herein, the term "(aryl-$C_{1-8}$alkyl)($C_{1-8}$alkyl)amino-$C_{1-8}$alkyl" refers to a radical of the formula: —$C_{1-8}$alkyl-N($C_{1-8}$alkyl)($C_{1-8}$alkyl-aryl).

As used herein, the term "aryl-amino" refers to a radical of the formula: —NH-aryl.

As used herein, the term "aryl-amino-carbonyl" refers to a radical of the formula: —C(O)—NH-aryl.

As used herein, the term "aryl-sulfonyloxy-$C_{1-8}$alkyl" refers to a radical of the formula: —$C_{1-8}$alkyl-O—SO$_2$-aryl.

As used herein, the term "benzoxy-carbonyl" refers to a radical of the formula: —C(O)O—CH$_2$-phenyl.

As used herein, the term "$C_{3-14}$cycloalkyl-$C_{1-8}$alkyl" refers to a radical of the formula: —$C_{1-8}$alkyl-$C_{3-14}$cycloalkyl.

As used herein, the term "$C_{3-14}$cycloalkyl-amino" refers to a radical of the formula: —NH—$C_{3-14}$cycloalkyl.

As used herein, the term "$C_{3-14}$cycloalkyl-oxy" refers to a radical of the formula: —O—$C_{3-14}$cycloalkyl.

As used herein, the term "halo" or "halogen" generally refers to a halogen atom radical, including fluoro, chloro, bromo and iodo.

As used herein, the term "halo-$C_{1-8}$alkoxy" refers to a radical of the formula: —O—$C_{1-8}$alkyl-halo, wherein $C_{1-8}$alkyl is partially or completely substituted with one or more halogen atoms where allowed by available valences.

As used herein, the term "halo-$C_{1-8}$alkyl" refers to a radical of the formula: —$C_{1-8}$alkyl-halo, wherein $C_{1-8}$alkyl is partially or completely substituted with one or more halogen atoms where allowed by available valences.

As used herein, the term "halo-$C_{1-8}$alkyl-amino" refers to a radical of the formula: —NH—$C_{1-8}$alkyl-halo.

As used herein, the term "(halo-$C_{1-8}$alkyl)($C_{1-8}$alkyl)amino" refers to a radical of the formula: —N($C_{1-8}$alkyl)($C_{1-8}$alkyl-halo).

As used herein, the term "(halo-$C_{1-8}$alkyl)$_2$-amino" refers to a radical of the formula: —N($C_{1-8}$alkyl-halo)$_2$.

As used herein, the term "heteroaryl-$C_{1-8}$alkoxy" refers to a radical of the formula: —O—$C_{1-8}$alkyl-heteroaryl.

As used herein, the term "heteroaryl-$C_{1-8}$alkyl" refers to a radical of the formula: —$C_{1-8}$alkyl-heteroaryl.

As used herein, the term "heteroaryl-$C_{1-8}$alkyl-amino" refers to a radical of the formula: —NH—$C_{1-8}$alkyl-heteroaryl.

As used herein, the term "(heteroaryl-$C_{1-8}$alkyl)$_2$-amino" refers to a radical of the formula: —N($C_{1-8}$alkyl-heteroaryl)$_2$.

As used herein, the term "(heteroaryl-$C_{1-8}$alkyl)($C_{1-8}$alkyl)amino" refers to a radical of the formula: —N($C_{1-8}$alkyl)($C_{1-8}$alkyl-heteroaryl).

As used herein, the term "heteroaryl-$C_{1-8}$alkyl-amino-$C_{1-8}$alkyl" refers to a radical of the formula: —$C_{1-8}$alkyl-NH—$C_{1-8}$alkyl-heteroaryl.

As used herein, the term "(heteroaryl-$C_{1-8}$alkyl)$_2$-amino-$C_{1-8}$alkyl" refers to a radical of the formula: —$C_{1-8}$alkyl-N($C_{1-8}$alkyl-heteroaryl)$_2$.

As used herein, the term "(heteroaryl-$C_{1-8}$alkyl)($C_{1-8}$alkyl)amino-$C_{1-8}$alkyl" refers to a radical of the formula: —$C_{1-8}$alkyl-N($C_{1-8}$alkyl)($C_{1-8}$alkyl-heteroaryl).

As used herein, the term "heteroaryl-amino" refers to a radical of the formula: —NH-heteroaryl.

As used herein, the term "heterocyclyl-$C_{1-8}$alkoxy" refers to a radical of the formula: —O—$C_{1-8}$alkyl-heterocyclyl.

As used herein, the term "heterocyclyl-$C_{1-8}$alkyl" refers to a radical of the formula: —$C_{1-8}$alkyl-heterocyclyl.

As used herein, the term "heterocyclyl-$C_{1-8}$alkyl-amino" refers to a radical of the formula: —NH—$C_{1-8}$alkyl-heterocyclyl.

As used herein, the term "(heterocyclyl-$C_{1-8}$alkyl)$_2$-amino" refers to a radical of the formula: —N($C_{1-8}$alkyl-heterocyclyl)$_2$.

As used herein, the term "(heterocyclyl-$C_{1-8}$alkyl)($C_{1-8}$alkyl)amino" refers to a radical of the formula: —N($C_{1-8}$alkyl)($C_{1-8}$alkyl-heterocyclyl).

As used herein, the term "heterocyclyl-$C_{1-8}$alkyl-amino-$C_{1-8}$alkyl" refers to a radical of the formula: —$C_{1-8}$alkyl-NH—$C_{1-8}$alkyl-heterocyclyl.

As used herein, the term "(heterocyclyl-$C_{1-8}$alkyl)$_2$-amino-$C_{1-8}$alkyl" refers to a radical of the formula: —$C_{1-8}$alkyl-N($C_{1-8}$alkyl-heterocyclyl)$_2$.

As used herein, the term "(heterocyclyl-$C_{1-8}$alkyl)($C_{1-8}$alkyl)amino-$C_{1-8}$alkyl" refers to a radical of the formula: —$C_{1-8}$alkyl-N($C_{1-8}$alkyl)($C_{1-8}$alkyl-heterocyclyl).

As used herein, the term "heterocyclyl-amino" refers to a radical of the formula: —NH-heterocyclyl.

As used herein, the term "(heterocyclyl)($C_{1-8}$alkyl)amino" refers to a radical of the formula: —N($C_{1-8}$alkyl)(heterocyclyl).

As used herein, the term "heterocyclyl-amino-$C_{1-8}$alkyl" refers to a radical of the formula: —$C_{1-8}$alkyl-NH-heterocyclyl.

As used herein, the term "heterocyclyl-carbonyl" refers to a radical of the formula: —C(O)-heterocyclyl.

As used herein, the term "heterocyclyl-carbonyl-oxy" refers to a radical of the formula: —O—C(O)-heterocyclyl.

As used herein, the term "heterocyclyl-oxy" refers to a radical of the formula: —O-heterocyclyl.

As used herein, the term "hydroxy" refers to a radical of the formula: —OH.

As used herein, the term "hydroxy-$C_{1-8}$alkoxy-$C_{1-8}$alkyl" refers to a radical of the formula: —$C_{1-8}$alkyl-O—$C_{1-8}$alkyl-OH.

As used herein, the term "hydroxy-$C_{1-8}$alkyl" refers to a radical of the formula: —$C_{1-8}$alkyl-OH, wherein $C_{1-8}$alkyl is partially or completely substituted with one or more hydroxy radicals where allowed by available valences.

As used herein, the term "hydroxy-$C_{1-8}$alkyl-amino" refers to a radical of the formula: —NH—$C_{1-8}$alkyl-OH.

As used herein, the term "(hydroxy-$C_{1-8}$alkyl)$_2$-amino" refers to a radical of the formula: —N($C_{1-8}$alkyl-OH)$_2$.

As used herein, the term "(hydroxy-$C_{1-8}$alkyl)($C_{1-8}$alkyl)amino" refers to a radical of the formula: —N($C_{1-8}$alkyl)($C_{1-8}$alkyl-OH).

As used herein, the term "hydroxy-$C_{1-8}$alkyl-amino-$C_{1-8}$alkyl" refers to a radical of the formula: —$C_{1-8}$alkyl-NH—$C_{1-8}$alkyl-OH.

As used herein, the term "(hydroxy-$C_{1-8}$alkyl)$_2$-amino-$C_{1-8}$alkyl" refers to a radical of the formula: —$C_{1-8}$alkyl-N($C_{1-8}$alkyl-OH)$_2$.

As used herein, the term "(hydroxy-$C_{1-8}$alkyl)($C_{1-8}$alkyl)amino-$C_{1-8}$alkyl" refers to a radical of the formula: —$C_{1-8}$alkyl-N($C_{1-8}$alkyl)($C_{1-8}$alkyl-OH).

As used herein, the term "hydroxy-$C_{1-8}$alkyl-amino-$C_{1-8}$alkoxy" refers to a radical of the formula: —O—$C_{1-8}$alkyl-NH—$C_{1-8}$alkyl-OH.

As used herein, the term "(hydroxy-$C_{1-8}$alkyl)$_2$-amino-$C_{1-8}$alkoxy" refers to a radical of the formula: —O—$C_{1-8}$alkyl-N($C_{1-8}$alkyl-OH)$_2$.

As used herein, the term "(hydroxy-$C_{1-8}$alkyl)($C_{1-8}$alkyl) amino-$C_{1-8}$alkoxy" refers to a radical of the formula: —O—$C_{1-8}$alkyl-N($C_{1-8}$alkyl)($C_{1-8}$alkyl-OH).

As used herein, the term "hydroxy-$C_{1-8}$alkyl-amino-$C_{1-8}$alkyl-amino" refers to a radical of the formula: —NH—$C_{1-8}$alkyl-NH—$C_{1-8}$alkyl-OH.

As used herein, the term "(hydroxy-$C_{1-8}$alkyl-amino-$C_{1-8}$alkyl)$_2$-amino" refers to a radical of the formula: —N($C_{1-8}$alkyl-NH—$C_{1-8}$alkyl-OH)$_2$.

As used herein, the term "(hydroxy-$C_{1-8}$alkyl)$_2$-amino-$C_{1-8}$alkyl-amino" refers to a radical of the formula: —NH—$C_{1-8}$alkyl-N($C_{1-8}$alkyl-OH)$_2$.

As used herein, the term "(hydroxy-$C_{1-8}$alkyl-amino-$C_{1-8}$alkyl)($C_{1-8}$alkyl)amino" refers to a radical of the formula: —N($C_{1-8}$alkyl)($C_{1-8}$alkyl-NH—$C_{1-8}$alkyl-OH).

As used herein, the term "[(hydroxy-$C_{1-8}$alkyl)$_2$-amino-$C_{1-8}$alkyl]($C_{1-8}$alkyl)amino" refers to a radical of the formula: —N($C_{1-8}$alkyl)[$C_{1-8}$alkyl-N($C_{1-8}$alkyl-OH)$_2$].

As used herein, the term "(hydroxy-$C_{1-8}$alkyl)($C_{1-8}$alkyl) amino-$C_{1-8}$alkyl-amino" refers to a radical of the formula: —NH—$C_{1-8}$alkyl-N($C_{1-8}$alkyl, $C_{1-8}$alkyl-OH).

As used herein, the term "[(hydroxy-$C_{1-8}$alkyl)($C_{1-8}$alkyl) amino-$C_{1-8}$alkyl]($C_{1-8}$alkyl)amino" refers to a radical of the formula: —N($C_{1-8}$alkyl)[$C_{1-8}$alkyl-N($C_{1-8}$alkyl)($C_{1-8}$alkyl-OH)].

As used herein, the term "substituent" means positional variables on the atoms of a core molecule that are attached at a designated atom position, replacing one or more hydrogen atoms on the designated atom, provided that the atom of attachment does not exceed the available valence or shared valences, such that the substitution results in a stable compound. Accordingly, combinations of substituents and/or variables are permissible only if such combinations result in stable compounds. It should also be noted that any carbon as well as heteroatom with a valence level that appears to be unsatisfied as described or shown herein is assumed to have a sufficient number of hydrogen atom(s) to satisfy the valences described or shown.

For the purposes of this description, where one or more substituent variables for a compound of Formula (I) encompass functionalities incorporated into a compound of Formula (I), each functionality appearing at any location within the disclosed compound may be independently selected, and as appropriate, independently and/or optionally substituted.

As used herein, the terms "independently selected," or "each selected" refer to functional variables in a substituent list that may be attached more than once on the structure of a core molecule, where the pattern of substitution at each occurrence is independent of the pattern at any other occurrence. Further, the use of a generic substituent on a core structure for a compound provided herein is understood to include the replacement of the generic substituent with specie substituents that are included within the particular genus, e.g., aryl may be independently replaced with phenyl or naphthalenyl (also referred to as naphthyl) and the like, such that the resulting compound is intended to be included within the scope of the compounds described herein.

As used herein, the term "each instance of" when used in a phrase such as " . . . aryl, aryl-$C_{1-8}$alkyl, heterocyclyl and heterocyclyl-$C_{1-8}$alkyl, wherein each instance of aryl and heterocyclyl is optionally substituted with one or two substituents . . . " is intended to include optional, independent substitution on each of the aryl and heterocyclyl rings and on the aryl and heterocyclyl portions of aryl-$C_{1-8}$alkyl and heterocyclyl-$C_{1-8}$alkyl.

As used herein, the term "optionally substituted" means that the specified substituent variables, groups, radicals or moieties represent the scope of the genus and may be independently chosen as needed to replace one or more hydrogen atoms on the designated atom of attachment of a core molecule.

As used herein, the terms "stable compound" or "stable structure" mean a compound that is sufficiently robust to be isolated to a useful degree of purity from a reaction mixture and formulations thereof into an efficacious therapeutic agent.

Compound names provided herein were obtained using ACD Labs Index Name software provided by ACD Labs and/or ChemDraw Ultra software provided by CambridgeSoft®. When the compound name disclosed herein conflicts with the structure depicted, the structure shown will supercede the use of the name to define the compound intended. Nomenclature for substituent radicals defined herein may differ slightly from the chemical name from which they are derived; one skilled in the art will recognize that the definition of the substituent radical is intended to include the radical as found in the chemical name.

As used herein the term "aberrant" refers to a deviation from the norm of, e.g., the average healthy subject or a cell(s) or tissue sample from a healthy subject. The term "aberrant expression," as used herein, refers to abnormal expression (up-regulated or down-regulated resulting in an excessive or deficient amount thereof) of a gene product (e.g., RNA transcript or protein) by a cell, tissue sample, or subject relative to a corresponding normal, healthy cell, tissue sample or subject. In a specific embodiment, the "aberrant expression" refers to an altered level of a gene product (e.g., RNA transcript or protein) in a cell, tissue sample, or subject relative to a corresponding normal, healthy cell, tissue sample or subject. The term "aberrant amount" as used herein refers to an altered level of a gene product (e.g., RNA, protein, polypeptide, or peptide) in a cell, tissue sample, or subject relative to a corresponding normal, healthy cell, tissue sample or subject. In specific embodiments, the amount of a gene product (e.g., RNA, protein, polypeptide, or peptide) in a cell, tissue sample, or subject relative to a corresponding cell or tissue sample from a healthy subject or a healthy subject, is considered aberrant if it is 1, 1.5, 2, 2.5, 3, 3.5, 4, 4.5, 5, 5.5, 6-fold or more above or below the amount of the gene product in the corresponding cell or tissue sample from a healthy subject or healthy subject.

The term "intronic REMS" refers to a REMS sequence present in an intron that functions as a 5' splice site in the presence of a compound described herein. The intronic REMS, when downstream of a first branch point (BP) sequence and a first 3' splice site (3'ss) sequence and upstream of a second branch point (BP) sequence and a second 3' splice site (3'ss) sequence) (as shown in FIG. 1A) and in the presence of a compound described herein, can function as a 5' splice site. The intronic REMS may also function as a 5' splice site when upstream of a first branch point and a first 3' splice site in the presence of a compound described herein (see FIG. 1B or 1C). Any one, two, three, or more or all of the following may be present endogenously or non-endogenously in the affected intron: the intronic REMS, the first BP, the second BP, the first 3'ss, and the second 3'ss.

As used herein, a "non-endogenous" nucleotide sequence (such as a non-endogenous 5' splice site, a non-endogenous branch point or a non-endogenous 3' splice site) is a nucleotide sequence not naturally found to be part of a pre-RNA or a DNA sequence encoding a pre-RNA sequence. In other words, the hand of man is required to synthesize or manipulate the RNA or DNA sequence to introduce the nucleotide sequence.

As used herein, the term "non-endogenous intronic REMS" refers to a REMS sequence not naturally found to be part of an RNA sequence or naturally encoded by a DNA sequence. In other words, the hand of man is required to manipulate the RNA or DNA sequence to introduce the intronic REMS or the nucleotide sequence encoding the REMS into an intron.

As used herein, the terms "intron-derived exon," "intronic exon," "iExon" and "intronic exon" (collectively iExon) refers to the formation of an exon from an RNA sequence present in an intron following splicing of an RNA transcript in the presence of a compound described herein or another agent which results in an iREMS functioning as an intronic 5' splice site. In particular, an iExon comprises the following RNA sequence as an exon when RNA splicing of an RNA transcript comprising two exons and an intron occurs in the presence of a compound described herein, wherein a first exon is upstream of the intron and a second exon is downstream of the intron, and wherein the intron comprises a first 5' splice site, a first branch point, a first 3' splice site, an iREMS, a second branch point, and a second 3' splice site: the RNA sequence between the first 3' splice site and the iREMS, as shown in FIG. 1A. One or more of the iREMS sequence, branch point and 3' splice site may be naturally present in an intron or may be introduced into the intron. When all such elements are present or introduced, in the presence of a compound described herein the elements define an exonic boundary that enables the splicing machinery to generate an iExon in RNA, a result that would not naturally occur without the addition of a splicing modulator compound.

As used herein, the term "pseudoexon" refers to a potential exon in intronic regions of pre-mRNA that is not normally spliced into mature mRNA. A subset of pseudoexons are spliced in the presence of a compound described herein or another agent resulting from an iREMS functioning as a 5' splice site within the pseudoexon, to form an iExon. An intronic REMS-containing pseudoexon is not known to be endogenously recognized by the splicing machinery for producing an iExon, but in the presence of a splicing modulator compound as described herein, the splicing machinery produces an iExon. Accordingly, production of an iExon from a pseudoexon is intended to be included within the scope of various aspects of the collective term "iExon."

As used herein, the term "unannotated exon" refers to endogenous sequences that are naturally present as exons in mature mRNA product according to experimental evidence but are not annotated in NCBI's RefSeq database (https://www.ncbi.nlm.nih.gov/refseq/). Some unannotated exons contain an intronic REMS at the 5' splice site. A REMS-containing unannotated exon is not known to be endogenously recognized by the splicing machinery for producing an iExon, but in the presence of a splicing modulator compound as described herein, the splicing machinery produces an iExon. Accordingly, production of an iExon from an unannotated exon is intended to be included within the scope of various aspects of the collective term "iExon."

As used herein, the term "substantial change" in the context of the amount of one or more RNA transcripts (e.g., rRNA, tRNA, miRNA, siRNA, piRNA, lncRNA, pre-mRNA or mRNA transcripts), an alternative splice variant thereof or an isoform thereof, or one or more proteins thereof, each expressed as the product of one or more of genes, means that the amount of such products changes by a statistically significant amount such as, in a nonlimiting example, a p value less than a value selected from 0.1, 0.01, 0.001, or 0.0001.

As used herein, the terms "subject" and "patient" are used interchangeably to refer to an animal or any living organism having sensation and the power of voluntary movement, and which requires for its existence oxygen and organic food. Non-limiting examples include members of the human, equine, porcine, bovine, rattus, murine, canine and feline species. In some embodiments, the subject is a mammal or a warm-blooded vertebrate animal. In certain embodiments, the subject is a non-human animal. In specific embodiments, the subject is a human.

As used herein, the term "functional protein" refers to a form of a protein that retains a certain biological function or the functions of a full length protein or protein isoform encoded by a gene. Accordingly, inclusion of an iExon that is located in the protein coding region of an mRNA that expresses a functional protein is intended to be included within the scope of the description herein.

As used herein, the term "non-functional protein" refers to a form of a protein that does not retain any biological function compared to full length protein or a protein isoform encoded by a gene in the absence of a splicing modifier compound as described herein. Accordingly, inclusion of an iExon that is located in the protein coding region of an mRNA that expresses a non-functional protein is intended to be included within the scope of the description herein.

As used herein, in the context of a functional protein produced from an artificial construct, the term "produce substantially less" means that the amount of functional protein produced in the presence of a compound described herein is at least substantially 20%, 25%, 30%, 35%, 40%, 45%, 50%, 55%, 60%, 70%, 75%, 80%, 85%, 90%, 95%, 98%, or 100% less than the amount of functional protein produced in the absence of the compound.

Compound Forms

As used herein, the terms "a compound of Formula (Ia)," "a compound of Formula (Ia1)," "a compound of Formula (Ia2)," "a compound of Formula (Ia3)," "a compound of Formula (Ia4)," "a compound of Formula (II)," "a compound of Formula (IIa)," "a compound of Formula (IIa1)," "a compound of Formula (IIa2)," "a compound of Formula (IIa3)," "a compound of Formula (IIa4)," "a compound of Formula (III)," "a compound of Formula (IIIa)," "a compound of Formula (IIIa1)," "a compound of Formula (IIIa2)," "a compound of Formula (IIIa3)," "a compound of Formula (IIIa4)," "a compound of Formula (IV)," "a compound of Formula (IVa)," "a compound of Formula (IVa1)," "a compound of Formula (IVa2)," "a compound of Formula (V)," "a compound of Formula (Va)," "a compound of Formula (Va1)," "a compound of Formula (Va2)," "a compound of Formula (VI)," "a compound of Formula (VIa)," "a compound of Formula (VIa1)," "a compound of Formula (VIa2)," "a compound of Formula (VIa3)," "a compound of Formula (VIa4)," "a compound of Formula (VII)," "a compound of Formula (VIIa)," "a compound of Formula (VIIa1)," "a compound of Formula (VIIa2)," "a compound of Formula (VIII)," "a compound of Formula (VIIIa)," "a compound of Formula (VIIIa1)," "a compound of Formula (VIIIa2)," "a compound of Formula (IX)," "a compound of Formula (IXa)," "a compound of Formula (IXa1)," "a compound of Formula (IXa2)," "a compound of Formula (IXa3)," "a compound of Formula (IXa4)," "a compound of Formula (X)," "a compound of Formula (Xa)," "a compound of Formula (Xa1)," "a compound of Formula (Xa2),"

"a compound of Formula (XI)," "a compound of Formula (XIa)," "a compound of Formula (XIa1)," "a compound of Formula (XIa2)," "a compound of Formula (XII)," "a compound of Formula (XIIa)," "a compound of Formula (XIIa1)," "a compound of Formula (XIIa2)," "a compound of Formula (XIIa3)," "a compound of Formula (XIIa4)," "a compound of Formula (XIII)," "a compound of Formula (XIIIa)," "a compound of Formula (XIIIa1)," "a compound of Formula (XIIIa2)," "a compound of Formula (XIV)," "a compound of Formula (XIVa)," "a compound of Formula (XIVa1)," and "a compound of Formula (XIVa2)," each refer to subgenera of the compound of Formula (I) or a form thereof.

Rather than repeat embodiments for the various subgenera of the compound of Formula (I), in certain embodiments, the term "a compound of Formula (I) or a form thereof" is used to inclusively to refer to a compound of Formula (Ia) or a form thereof, a compound of Formula (Ia1) or a form thereof, a compound of Formula (Ia2) or a form thereof, a compound of Formula (Ia3) or a form thereof, a compound of Formula (Ia4) or a form thereof, a compound of Formula (II) or a form thereof, a compound of Formula (IIa) or a form thereof, a compound of Formula (IIa1) or a form thereof, a compound of Formula (IIa2) or a form thereof, a compound of Formula (IIa3) or a form thereof, a compound of Formula (IIa4) or a form thereof, a compound of Formula (III) or a form thereof, a compound of Formula (IIIa) or a form thereof, a compound of Formula (IIIa1) or a form thereof, a compound of Formula (IIIa2) or a form thereof, a compound of Formula (IIIa3) or a form thereof, a compound of Formula (IIIa4) or a form thereof, a compound of Formula (IV) or a form thereof, a compound of Formula (IVa) or a form thereof, a compound of Formula (IVa1) or a form thereof, a compound of Formula (IVa2) or a form thereof, a compound of Formula (V) or a form thereof, a compound of Formula (Va) or a form thereof, a compound of Formula (Va1) or a form thereof, a compound of Formula (Va2) or a form thereof, a compound of Formula (VI) or a form thereof, a compound of Formula (VIa) or a form thereof, a compound of Formula (VIa1) or a form thereof, a compound of Formula (VIa2) or a form thereof, a compound of Formula (VIa3) or a form thereof, a compound of Formula (VIa4) or a form thereof, a compound of Formula (VII) or a form thereof, a compound of Formula (VIIa) or a form thereof, a compound of Formula (VIIa1) or a form thereof, a compound of Formula (VIIa2) or a form thereof, a compound of Formula (VIII) or a form thereof, a compound of Formula (VIIIa) or a form thereof, a compound of Formula (VIIIa1) or a form thereof, a compound of Formula (VIIIa2) or a form thereof, a compound of Formula (IX) or a form thereof, a compound of Formula (IXa) or a form thereof, a compound of Formula (IXa1) or a form thereof, a compound of Formula (IXa2) or a form thereof, a compound of Formula (IXa3) or a form thereof, a compound of Formula (IXa4) or a form thereof, a compound of Formula (X) or a form thereof, a compound of Formula (Xa) or a form thereof, a compound of Formula (Xa1) or a form thereof, a compound of Formula (Xa2) or a form thereof, a compound of Formula (XI) or a form thereof, a compound of Formula (XIa) or a form thereof, a compound of Formula (XIa1) or a form thereof, a compound of Formula (XIa2) or a form thereof, a compound of Formula (XII) or a form thereof, a compound of Formula (XIIa) or a form thereof, a compound of Formula (XIIa1) or a form thereof, a compound of Formula (XIIa2) or a form thereof, a compound of Formula (XIIa3) or a form thereof, a compound of Formula (XIIa4) or a form thereof, a compound of Formula (XIII) or a compound of Formula (XIIIa) or a form thereof, a compound of Formula (XIIIa1) or a form thereof, a compound of Formula (XIIIa2) or a form thereof, a compound of Formula (XIV) or a form thereof, a compound of Formula (XIVa) or a form thereof, a compound of Formula (XIVa1) or a form thereof or a compound of Formula (XIVa2) or a form thereof, either separately or together.

Thus, embodiments and references to "a compound of Formula (I)" are intended to be inclusive of compounds of Formula (Ia), Formula (Ia1), Formula (Ia2), Formula (Ia3), Formula (Ia4), Formula (II), Formula (IIa), Formula (IIa1), Formula (IIa2), Formula (IIa3), Formula (IIa4), Formula (III), Formula (IIIa), Formula (IIIa1), Formula (IIIa2), Formula (IIIa3), Formula (IIIa4), Formula (IV), Formula (IVa), Formula (IVa1), Formula (IVa2), Formula (V), Formula (Va), Formula (Va1), Formula (Va2), Formula (VI), Formula (VIa), Formula (VIa1), Formula (VIa2), Formula (VIa3), Formula (VIa4), Formula (VII), Formula (VIIa), Formula (VIIa1), Formula (VIIa2), Formula (VIII), Formula (VIIIa), Formula (VIIIa1), Formula (VIIIa2), Formula (IX), Formula (IXa), Formula (IXa1), Formula (IXa2), Formula (IXa3), Formula (IXa4), Formula (X), Formula (Xa), Formula (Xa1), Formula (Xa2), Formula (XI), Formula (XIa), Formula (XIa1), Formula (XIa2), Formula (XII), Formula (XIIa), Formula (XIIa1), Formula (XIIa2), Formula (XIIa3), Formula (XIIa4), Formula (XIII), Formula (XIIIa), Formula (XIIIa1), Formula (XIIIa2), Formula (XIV), Formula (XIVa), Formula (XIVa1) and Formula (XIVa2).

As used herein, the term "form" means a compound of Formula (I) selected from a free acid, free base, salt, isotopologue, stereoisomer, racemate, enantiomer, diastereomer, or tautomer thereof.

In certain embodiments described herein, the form of the compound of Formula (I) is a selected from a salt, isotopologue, stereoisomer, racemate, enantiomer, diastereomer or tautomer thereof.

In certain embodiments described herein, the form of the compound of Formula (I) is a selected from a free acid, isotopologue, stereoisomer, racemate, enantiomer, diastereomer or tautomer thereof.

In certain embodiments described herein, the form of the compound of Formula (I) is a selected from a free base, isotopologue, stereoisomer, racemate, enantiomer, diastereomer or tautomer thereof.

In certain embodiments described herein, the form of the compound of Formula (I) is a free acid, free base or salt thereof.

In certain embodiments described herein, the form of the compound of Formula (I) is an isotopologue thereof.

In certain embodiments described herein, the form of the compound of Formula (I) is a stereoisomer, racemate, enantiomer or diastereomer thereof.

In certain embodiments described herein, the form of the compound of Formula (I) is a tautomer thereof.

In certain embodiments described herein, the form of the compound of Formula (I) is a pharmaceutically acceptable form.

In certain embodiments described herein, the compound of Formula (I) or a form thereof is isolated for use.

As used herein, the term "isolated" means the physical state of a compound of Formula (I) or a form thereof after being isolated and/or purified from a synthetic process (e.g., from a reaction mixture) or natural source or combination thereof according to an isolation or purification process or processes described herein or which are well known to the skilled artisan (e.g., chromatography, recrystallization and the like) in sufficient purity to be characterizable by standard analytical techniques described herein or well known to the skilled artisan.

As used herein, the term "protected" means that a functional group on a compound of Formula (I) is in a form modified to preclude undesired side reactions at the protected site when the compound is subjected to a reaction. Suitable protecting groups will be recognized by those with ordinary skill in the art as well as by reference to standard textbooks such as, for example, T. W. Greene et al, Protective Groups in Organic Synthesis (1991), Wiley, New York.

Prodrugs of a compound of Formula (I) or a form thereof are also contemplated herein.

As used herein, the term "prodrug" means that a functional group on a compound of Formula (I) is in a form (e.g., acting as an active or inactive drug precursor) that is transformed in vivo to yield an active or more active compound of Formula (I) or a form thereof. The transformation may occur by various mechanisms (e.g., by metabolic and/or non-metabolic chemical processes), such as, for example, by hydrolysis and/or metabolism in blood, liver and/or other organs and tissues. A discussion of the use of prodrugs is provided by V. J. Stella, et. al., "Biotechnology: Pharmaceutical Aspects, Prodrugs: Challenges and Rewards," American Association of Pharmaceutical Scientists and Springer Press, 2007.

In one example, when a compound of Formula (I) or a form thereof contains a carboxylic acid functional group, a prodrug can comprise an ester formed by the replacement of the hydrogen atom of the acid group with a functional group such as alkyl and the like. In another example, when a compound of Formula (I) or a form thereof contains an alcohol functional group, a prodrug can be formed by the replacement of the hydrogen atom of the alcohol group with a functional group such as alkyl or substituted carbonyl and the like. In another example, when a compound of Formula (I) or a form thereof contains an amine functional group, a prodrug can be formed by the replacement of one or more amine hydrogen atoms with a functional group such as alkyl or substituted carbonyl. In another example, when a compound of Formula (I) or a form thereof contains a hydrogen substituent, a prodrug can be formed by the replacement of one or more hydrogen atoms with an alkyl substituent.

Pharmaceutically acceptable prodrugs of compounds of Formula (I) or a form thereof include those compounds substituted with one or more of the following groups: carboxylic acid esters, sulfonate esters, amino acid esters phosphonate esters, mono-, di- or triphosphate esters or alkyl substituents where appropriate. As described herein, it is understood by a person of ordinary skill in the art that one or more of such substituents may be used to provide a compound of Formula (I) or a form thereof for use as a prodrug.

The compounds of Formula (I) can form salts which are intended to be included within the scope of this description. Reference to a compound of Formula (I) herein is understood to include reference to salts thereof, unless otherwise indicated. The term "salt(s)", as employed herein, denotes acidic salts formed with inorganic and/or organic acids, as well as basic salts formed with inorganic and/or organic bases. In addition, when a compound of Formula (I) contains both a basic moiety, such as, but not limited to a pyridine or imidazole, and an acidic moiety, such as, but not limited to a carboxylic acid, zwitterions ("inner salts") may be formed and are included within the term "salt(s)" as used herein.

The term "pharmaceutically acceptable salt(s)", as used herein, means those salts of compounds described herein that are safe and effective (i.e., non-toxic, physiologically acceptable) for use in mammals and that possess biological activity, although other salts are also useful. Salts of the compounds of Formula (I) may be formed, for example, by reacting a compound of Formula (I) with an amount of acid or base, such as an equivalent or stoichiometric amount, in a medium such as one in which the salt precipitates or in an aqueous medium followed by lyophilization.

Pharmaceutically acceptable salts include one or more salts of acidic or basic groups present in compounds described herein. Embodiments of acid addition salts include, and are not limited to, acetate, acid phosphate, ascorbate, benzoate, benzenesulfonate, bisulfate, bitartrate, borate, butyrate, chloride, citrate, camphorate, camphorsulfonate, ethanesulfonate, formate, fumarate, gentisinate, gluconate, glucaronate, glutamate, hydrobromide, hydrochloride, dihydrochloride, hydroiodide, isonicotinate, lactate, maleate, methanesulfonate, naphthalenesulfonate, nitrate, oxalate, pamoate, pantothenate, phosphate, propionate, saccharate, salicylate, succinate, sulfate, tartrate, thiocyanate, toluenesulfonate (also known as tosylate), trifluoroacetate salts and the like. One or more embodiments of acid addition salts include a chloride, hydrochloride, dihydrochloride, trihydrochloride, hydrobromide, acetate, diacetate or trifluoroacetate salt. More particular embodiments include a chloride, hydrochloride, dihydrochloride, hydrobromide or trifluoroacetate salt.

Additionally, acids which are generally considered suitable for the formation of pharmaceutically useful salts from basic pharmaceutical compounds are discussed, for example, by P. Stahl et al, Camille G. (eds.) Handbook of Pharmaceutical Salts. Properties, Selection and Use. (2002) Zurich: Wiley-VCH; S. Berge et al, Journal of Pharmaceutical Sciences (1977) 66(1) 1-19; P. Gould, International J. of Pharmaceutics (1986) 33, 201-217; Anderson et al, The Practice of Medicinal Chemistry (1996), Academic Press, New York; and in The Orange Book (see, website for Food & Drug Administration, Washington, D.C.). These disclosures are incorporated herein by reference thereto.

Suitable basic salts include, but are not limited to, aluminum, ammonium, calcium, lithium, magnesium, potassium, sodium, zinc, and diethanolamine salts. Certain compounds described herein can also form pharmaceutically acceptable salts with organic bases (for example, organic amines) such as, but not limited to, dicyclohexylamines, tert-butyl amines and the like, and with various amino acids such as, but not limited to, arginine, lysine and the like. Basic nitrogen-containing groups may be quarternized with agents such as lower alkyl halides (e.g., methyl, ethyl, and butyl chlorides, bromides and iodides), dialkyl sulfates (e.g., dimethyl, diethyl, and dibutyl sulfates), long chain halides (e.g., decyl, lauryl, and stearyl chlorides, bromides and iodides), aralkyl halides (e.g., benzyl and phenethyl bromides), and others.

All such acid salts and base salts are intended to be pharmaceutically acceptable salts within the scope of the description herein and all such acid and base salts are considered equivalent to the free forms of the corresponding compounds for the purposes described herein.

Compounds of Formula I and forms thereof may further exist in a tautomeric form. All such tautomeric forms are contemplated herein as part of the present description.

The compounds of Formula (I) may contain asymmetric or chiral centers, and, therefore, may exist in different stereoisomeric forms. The present description is intended to include all stereoisomeric forms of the compounds of Formula (I) as well as mixtures thereof, including racemic mixtures.

The compounds of Formula (I) described herein may include one or more chiral centers, and as such may exist as racemic mixtures (R/S) or as substantially pure enantiomers and diastereomers. The compounds may also exist as substantially pure (R) or (S) enantiomers (when one chiral center is present). In one embodiment, the compounds of Formula (I) described herein are (S) isomers and may exist as enantiomerically pure compositions substantially comprising only the (S) isomer. In another embodiment, the compounds of Formula (I) described herein are (R) isomers and may exist as enantiomerically pure compositions substantially comprising only the (R) isomer. As one of skill in the art will recognize, when more than one chiral center is present, the compounds of Formula (I) described herein may also include portions described as an (R,R), (R,S), (S,R) or (S,S) isomer, as defined by IUPAC Nomenclature Recommendations.

As used herein, the term "substantially pure" refers to compounds consisting substantially of a single isomer in an amount greater than or equal to 90%, in an amount greater than or equal to 92%, in an amount greater than or equal to 95%, in an amount greater than or equal to 98%, in an amount greater than or equal to 99%, or in an amount equal to 100% of the single isomer.

In one aspect, a compound of Formula (I) is a substantially pure (S) enantiomer present in an amount greater than or equal to 90%, in an amount greater than or equal to 92%, in an amount greater than or equal to 95%, in an amount greater than or equal to 98%, in an amount greater than or equal to 99%, or in an amount equal to 100%.

In one aspect, a compound of Formula (I) is a substantially pure (R) enantiomer present in an amount greater than or equal to 90%, in an amount greater than or equal to 92%, in an amount greater than or equal to 95%, in an amount greater than or equal to 98%, in an amount greater than or equal to 99%, or in an amount equal to 100%.

As used herein, a "racemate" is any mixture of isometric forms that are not "enantiomerically pure", including mixtures such as, without limitation, in a ratio of about 50/50, about 60/40, about 70/30, about 80/20, about 85/15 or about 90/10.

In addition, the present description embraces all geometric and positional isomers. For example, if a compound of Formula (I) incorporates a double bond or a fused ring, both the cis- and trans-forms, as well as mixtures, are embraced within the scope of the description herein.

Diastereomeric mixtures can be separated into their individual diastereomers on the basis of their physical chemical differences by methods well known to those skilled in the art, such as, for example, by chromatography and/or fractional crystallization. Enantiomers can be separated by use of chiral HPLC column or other chromatographic methods known to those skilled in the art.

Enantiomers can also be separated by converting the enantiomeric mixture into a diastereomeric mixture by reaction with an appropriate optically active compound (e.g., chiral auxiliary such as a chiral alcohol or Mosher's acid chloride), separating the diastereomers and converting (e.g., hydrolyzing) the individual diastereomers to the corresponding pure enantiomers. Also, some of the compounds of Formula (I) may be atropisomers (e.g., substituted biaryls) and are considered part of this description.

All stereoisomer forms (for example, geometric isomers, optical isomers, positional isomers and the like) of the present compounds (including salts, solvates, esters and prodrugs and transformed prodrugs thereof) which may exist due to asymmetric carbons on various substituents, including enantiomeric forms (which may exist even in the absence of asymmetric carbons), rotameric forms, atropisomers, diastereomeric forms and regioisomeric forms are contemplated within the scope of the description herein. For example, if a compound of Formula (I) incorporates a double bond or a fused ring, both the cis- and trans-forms, as well as mixtures thereof, are embraced within the scope of the description herein. Also, for example, all keto-enol and imine-enamine tautomeric forms of the compounds are included in the description herein. Individual stereoisomers of the compounds of Formula (I) described herein may, for example, be substantially free of other isomers, or may be present in a racemic mixture, as described supra.

The use of the terms "salt," "prodrug" and "transformed prodrug" are intended to equally apply to the salts, prodrugs and transformed prodrugs of all contemplated isotopologues, stereoisomers, racemates or tautomers of the instant compounds.

The term "isotopologue" refers to isotopically-enriched compounds which are identical to those recited herein, but for the fact that one or more atoms are replaced by an atom having an atomic mass or mass number different from the atomic mass or mass number usually found in nature. Examples of isotopes that can be incorporated into compounds described herein include isotopes of hydrogen, carbon, nitrogen, oxygen, phosphorus, fluorine and chlorine, such as $H^2$, $H^3$, $C^{13}$, $C^{14}$, $N^{15}$, $O^{18}$, $O^{17}$, $P^{31}$, $P^{32}$, $S^{35}$, $F^{18}$, $Cl^{35}$ and $Cl^{36}$, respectively, each of which is also within the scope of this description.

Certain isotopically-enriched compounds described herein (e.g., those labeled with $H^3$ and $C^{14}$) are useful in compound and/or substrate tissue distribution assays. Tritiated (i.e., $H^3$) and carbon-14 (i.e., $C^{14}$) isotopes are particularly preferred for their ease of preparation and detectability. Further, substitution with heavier isotopes such as deuterium (i.e., "deuterium enriched") may afford certain therapeutic advantages resulting from greater metabolic stability (e.g., increased in vivo half-life or reduced dosage requirements) and hence may be preferred in some circumstances. Isotopically-enriched compounds of Formula (I) can generally be prepared using procedures known to persons of ordinary skill in the art by substituting an appropriate isotopically-enriched reagent for a non-isotopically-enriched reagent.

When the compounds are enriched with deuterium, the deuterium-to-hydrogen ratio on the deuterated atoms of the molecule substantially exceeds the naturally occurring deuterium-to-hydrogen ratio.

An embodiment described herein may include an isotopologue form of the compound of Formula (I), wherein the isotopologue is substituted on one or more atom members of the compound of Formula (I) with one or more deuterium atoms in place of one or more hydrogen atoms.

An embodiment described herein may include a compound of Formula (I) and forms thereof, wherein a carbon atom may have from 1 to 3 hydrogen atoms optionally replaced with deuterium.

One or more compounds described herein may exist in unsolvated as well as solvated forms with pharmaceutically acceptable solvents such as water, ethanol, and the like, and the description herein is intended to embrace both solvated and unsolvated forms.

As used herein, the term "solvate" means a physical association of a compound described herein with one or more solvent molecules. This physical association involves varying degrees of ionic and covalent bonding, including hydrogen bonding. In certain instances the solvate will be capable of isolation, for example when one or more solvent molecules are incorporated in the crystal lattice of the crystalline solid. As used herein, "solvate" encompasses both solution-phase and isolatable solvates. Non-limiting examples of suitable solvates include ethanolates, methanolates, and the like.

One or more compounds described herein may optionally be converted to a solvate. Preparation of solvates is generally known. A typical, non-limiting process involves dissolving a compound in a desired amount of the desired solvent (organic or water or mixtures thereof) at a higher than ambient temperature, and cooling the solution at a rate sufficient to form crystals which are then isolated by standard methods. Analytical techniques such as, for example infrared spectroscopy, show the presence of the solvent (or water) in the crystals as a solvate (or hydrate).

As used herein, the term "hydrate" means a solvate wherein the solvent molecule is water.

Polymorphic crystalline and amorphous forms of the compounds of Formula (I), and of the salts, solvates, esters and prodrugs of the compounds of Formula (I), are further intended to be included in the scope of the compounds described herein Methods for Determining which Genes may be Modulated by the Compounds In another aspect, provided herein are methods for determining whether the splicing of the precursor RNA of a gene is likely to be modulated by a compound of Formula (I) or a form thereof, comprising searching for the presence of an intronic REMS (i.e., a sequence functioning as a 5' splice site) in a gene intronic sequence, wherein the presence of the intronic REMS 3' splice site and an intronic branch point in the gene sequence indicates that the splicing of the precursor RNA of the gene is likely to be modulated by the compound of Formula (I) or a form thereof, and the absence of the intronic REMS and an intronic 3' splice site and an intronic branch point in the gene sequence indicates that the splicing of the precursor RNA of the gene is unlikely to be modulated by the compound of Formula (I) or a form thereof. In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described herein. In specific embodiments, the methods further comprise searching for the presence of the combination of an intronic REMS, an intronic 3' splice site and an intronic branch point in the gene sequence.

In another aspect, provided herein are methods for determining whether the amount of a product (e.g., an mRNA transcript or protein) of a gene is likely to be modulated by a compound of Formula (I) or a form thereof, comprising searching for the presence of an intronic REMS in the gene sequence, wherein the presence of the combination of an intronic REMS, an intronic 3' splice site and an intronic branch point in the gene sequence indicates that the amount of a product (e.g., an mRNA transcript or protein) of the gene is likely to be modulated by the compound of Formula (I) or a form thereof, and the absence of the combination of an intronic REMS, an intronic 3' splice site and an intronic branch point in the gene sequence indicates that the amount of a product (e.g., an mRNA transcript or protein) of the gene is unlikely to be modulated by the compound of Formula (I) or a form thereof. In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described herein. In specific embodiments, the methods further comprise searching for the presence of any of an intronic REMS, an intronic 3' splice site, and an intronic branch point in the gene sequence.

The step of searching for the presence of an intronic REMS, an intronic 3' splice site, and an intronic branch point in the gene sequence described herein can be performed by a computer system comprising a memory storing instructions for searching for the presence of the intronic REMS, the intronic 3' splice site, and the intronic branch point in the gene sequence, or such a search can be performed manually.

Figure 1B:
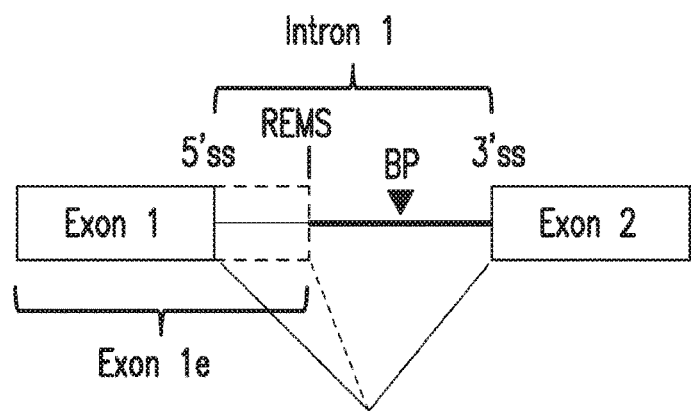
Figure 1C:
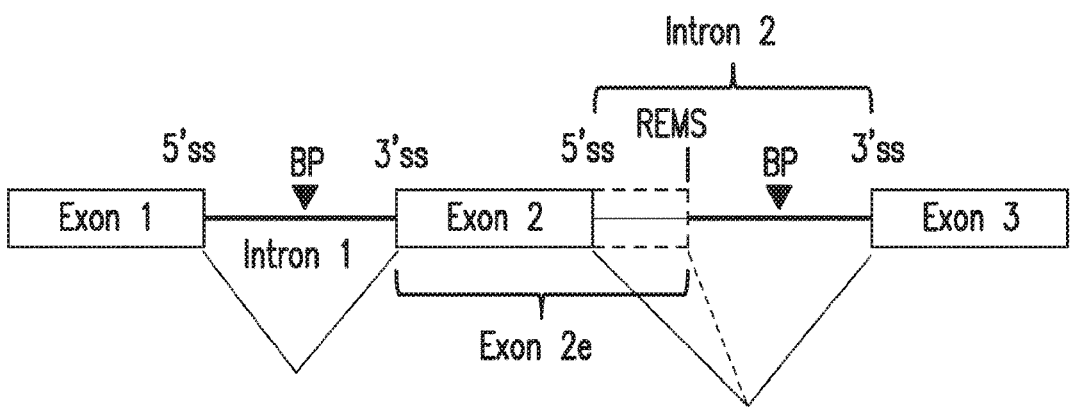
Figure 2A:
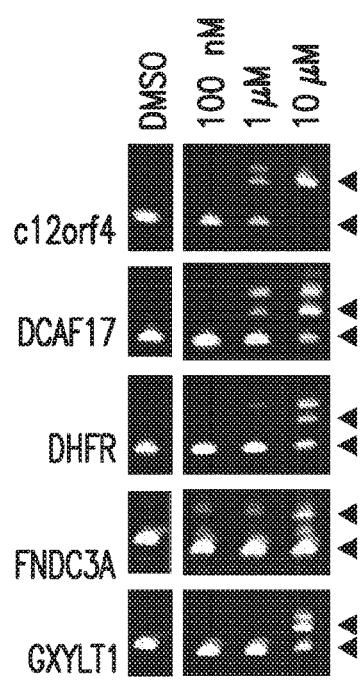
FIGS. 2A-2D, 3, 4, 5, 6A. The dose dependent production of iExons for certain genes (as specified in the figures) in the presence of certain compounds or control (DMSO) are shown, each of which represent aspects of the operation of an intronic REMS and compounds as described herein. Compounds used in the experiments depicted in FIGS. 3, 4, 5, and 6A are described herein. Compound 774 was used for the experiments depicted in FIGS. 2A-2D.
Figure 2B:
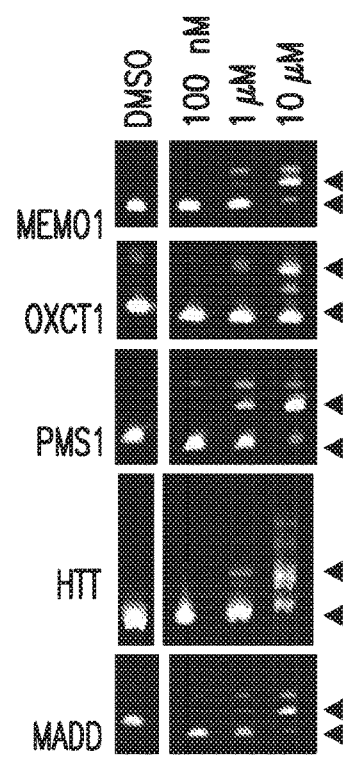
Figure 2C:
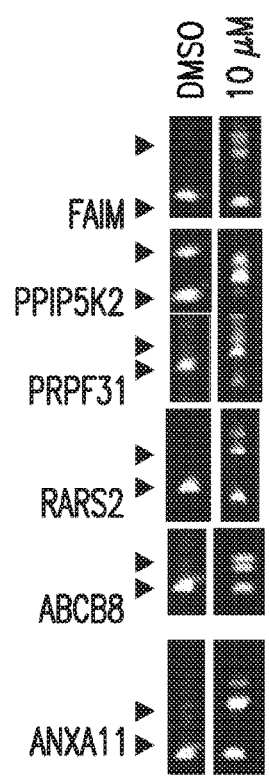
Figure 2D:
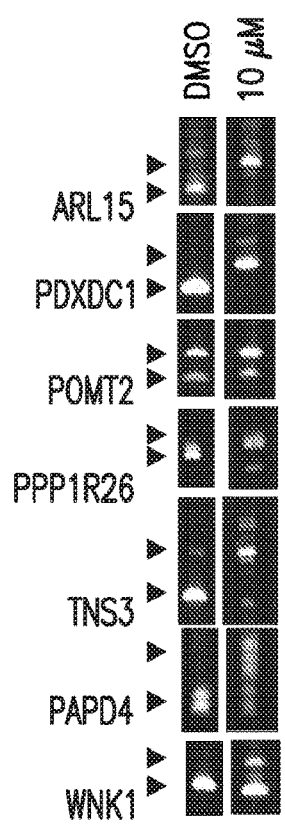
Figure 3:
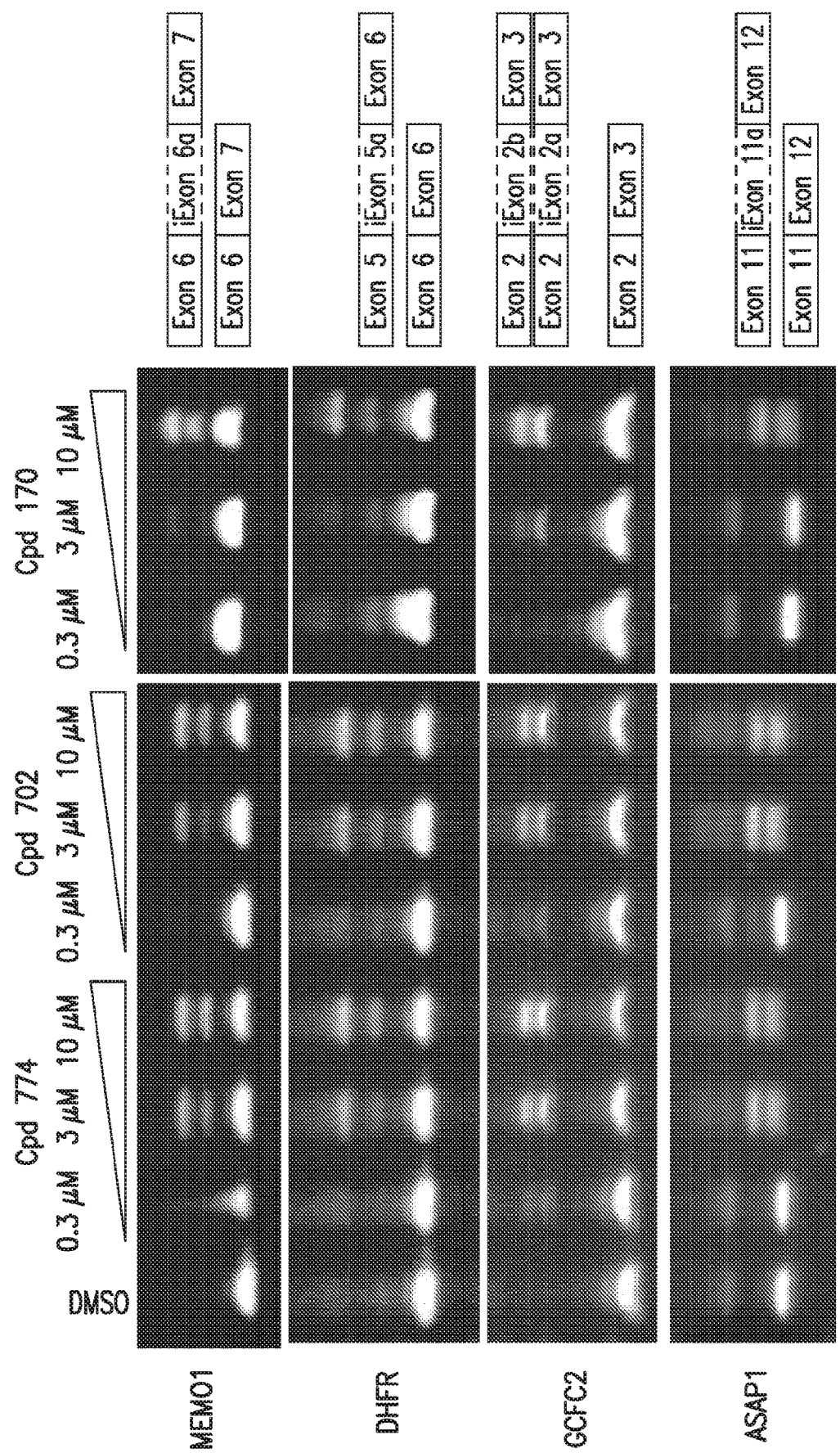
Figure 4:
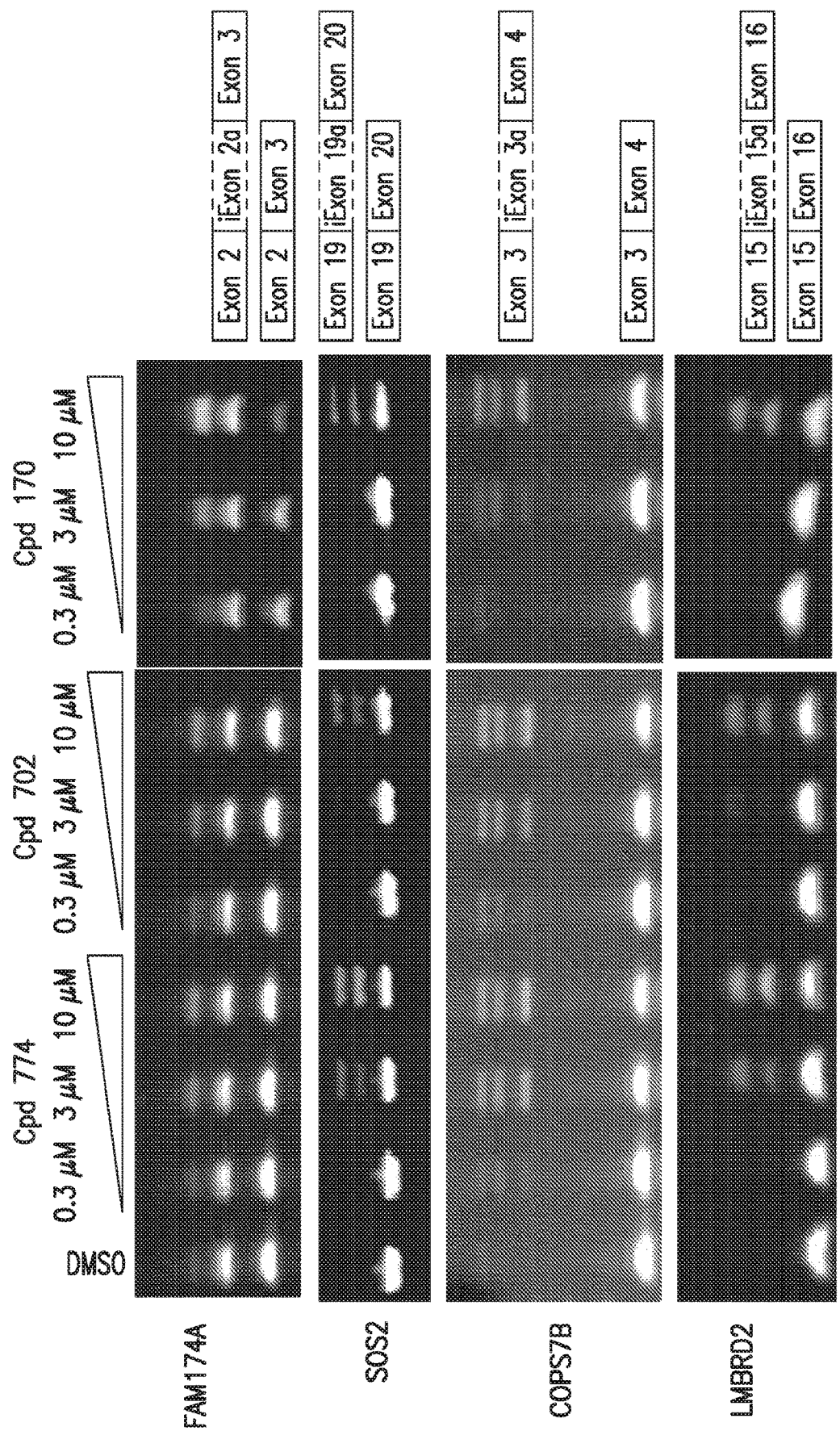
Figure 5:
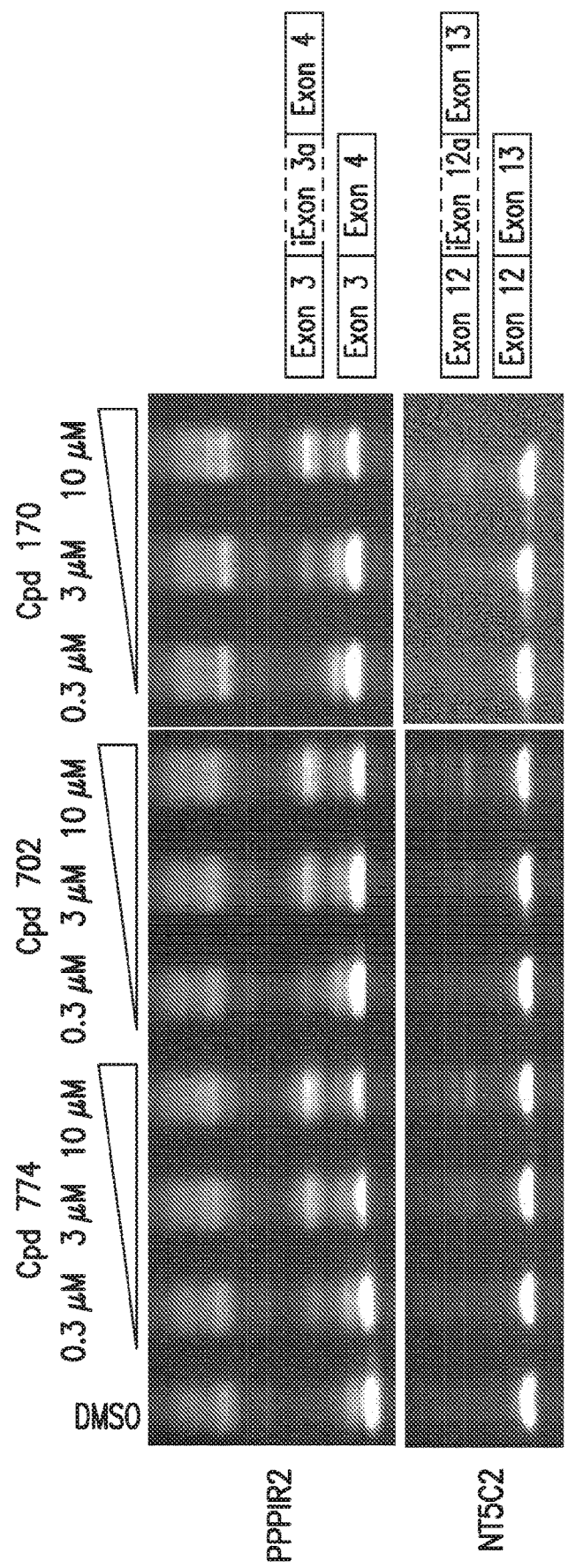
Figure 6A:
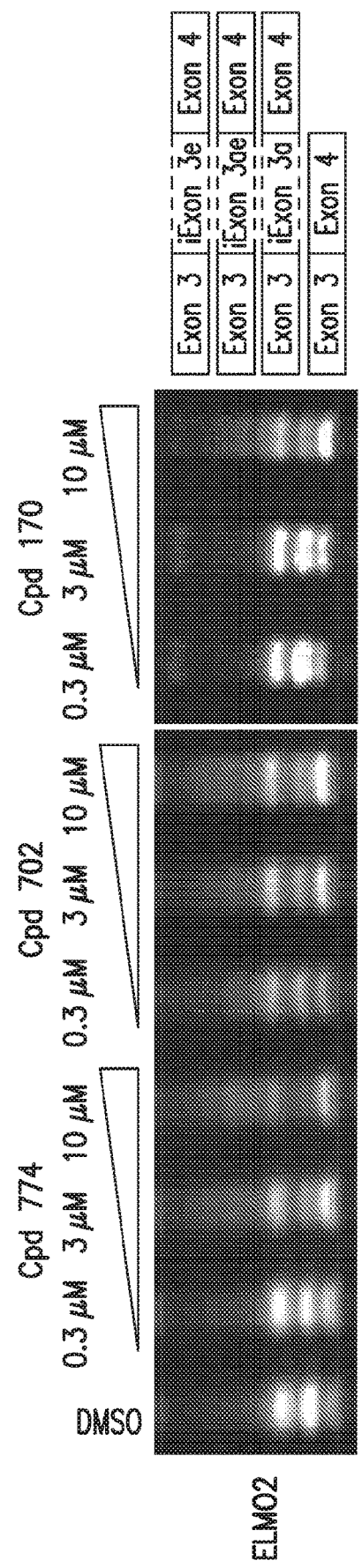
Figure 6B:
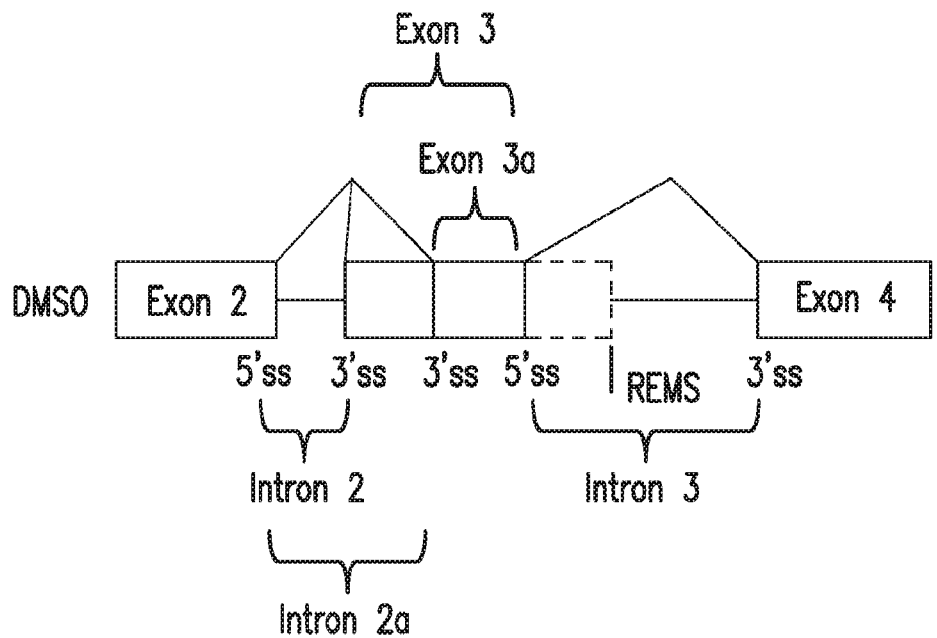
FIGS. 6B and 6C.
Figure 6C:
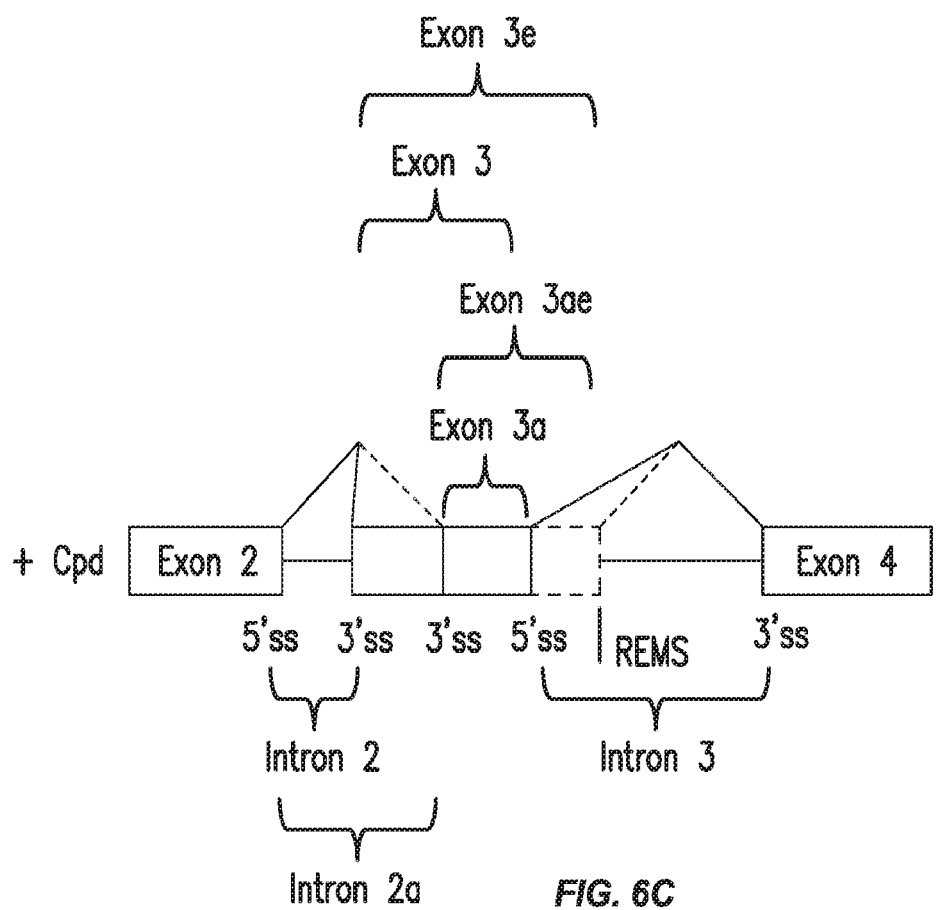

In another aspect, provided herein are methods for determining whether the splicing of the precursor RNA of a gene is likely to be modulated via iExon inclusion by a compound of Formula (I) or a form thereof. In one particular aspect, the method comprises searching for the presence of an intronic REMS (i.e., a sequence functioning as a 5' splice site) in combination with, in order, an upstream branch point and an upstream 3' splice site in a gene intronic sequence. The presence of these elements with the intronic REMS and the endogenous presence of a downstream 3' splice site and a downstream branch point in the gene sequence indicates that the splicing of the precursor RNA of the gene is likely to be modulated by the compound of Formula (I) or a form thereof. In this aspect, the presence of an upstream branch point and upstream 3' splice site and the REMS in the intron enable the presence of the compound of Formula (I) or a form thereof to modulate iExon inclusion, i.e., splicing the iExon with the downstream endogenous exon (as shown in FIG. 1A). Otherwise, in the absence of these elements, the iREMS will be either ignored by the spliceosome or, in a limited set of circumstances, will become an extended/cryptic 5' splice site for the upstream endogenous exon (as shown in FIGS. 1B and 1C). The absence of the intronic REMS in the gene sequence indicates that the splicing of the precursor RNA of the gene is unlikely to be modulated via iExon inclusion by the compound of Formula (I) or a form thereof. In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described herein. In other specific embodiments, the methods further comprise searching for the presence of the combination of, in 5' to 3' order: an upstream branch point, an upstream 3' splice site, an intronic REMS, a downstream branch point and a downstream 3' splice site in the gene sequence.

In another aspect, provided herein are methods for determining whether the amount of a product (e.g., an mRNA transcript or protein) of a gene is likely to be modulated via iExon inclusion by a compound of Formula (I) or a form thereof, comprising searching for the presence of an intronic REMS in the gene sequence, wherein the presence of the combination of at least an upstream branch point, an upstream 3' splice site and an intronic REMS in the gene sequence indicates that the amount of a product (e.g., an mRNA transcript or protein) of the gene is likely to be modulated via iExon inclusion by the compound of Formula (I) or a form thereof, and the absence of the combination of an upstream branch point, an upstream 3' splice site and an intronic REMS in the gene sequence indicates that the amount of a product (e.g., an mRNA transcript or protein) of the gene is unlikely to be modulated via iExon inclusion by the compound of Formula (I) or a form thereof. In certain embodiments, a compound of Formula (I) is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV) described herein. In specific embodiments, the methods further comprise searching for the presence of any of, in 5' to 3' order: an upstream branch point, an upstream 3' splice site, an intronic REMS, a downstream 3' splice site, and a downstream branch point in the gene sequence.

The step of searching for the presence of an upstream branch point, an upstream 3' splice site and an intronic REMS in any of the gene sequences in any of the genes described herein can be performed by a computer system comprising a memory storing instructions for searching for the presence of the intronic REMS, the upstream 3' splice site, and the upstream branch point in the gene sequence, or such a search can be performed manually.

In certain embodiments, the splicing of a precursor RNA containing an intronic REMS is assessed by contacting a compound described herein with the precursor RNA in cell culture. In some embodiments, the splicing of a precursor RNA containing an intronic REMS is assessed by contacting a compound described herein with the precursor RNA in a cell-free extract. In a specific embodiment, the compound is one known to modulate the splicing of a precursor RNA containing an exonic REMS. See, e.g., the section below relating to methods for determining whether a compound modulates the expression of certain genes, and the example below for techniques that could be used in these assessments.

Methods for Determining which Compounds of Formula (I) Modulate the Expression of Certain Genes Provided herein are methods for determining whether a compound of Formula (I) or a form thereof modulates the amount of one, two, three or more RNA transcripts (e.g., pre-mRNA or mRNA transcripts or isoforms thereof) of one, two, three or more genes. In some embodiments, the gene is any one of the genes disclosed in Tables 2-7 or any one of the genes disclosed in Table 1. In certain embodiments, the gene is a gene disclosed in Tables 2-6. In some embodiments, the gene is a gene disclosed in Table 7. In other embodiments, the gene is a gene disclosed in Table 1. In certain embodiments, the gene is a gene not disclosed in either International Publication No. WO 2015/105657, International Publication No. WO 2016/196386, or both.

In one embodiment, provided herein is a method for determining whether a compound of Formula (I) or a form thereof modulates the amount of an RNA transcript, comprising: (a) contacting a cell(s) with a compound of Formula (I) or a form thereof, and (b) determining the amount of the RNA transcript produced by the cell(s), wherein an alteration in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript. In another embodiment, provided herein is a method for determining whether a compound of Formula (I) or a form thereof modulates the amount of an RNA transcript (e.g., an mRNA transcript), comprising: (a) contacting a first cell(s) with a compound of Formula (I) or a form thereof, (b) contacting a second cell(s) with a negative control (e.g., a vehicle control, such as PBS or DMSO); and (c) determining the amount of the RNA transcript produced by the first cell(s) and the second cell(s); and (d) comparing the amount of the RNA transcript produced by the first cell(s) to the amount of the RNA transcript expressed by the second cell(s), wherein an alteration in the amount of the RNA transcript produced by the first cell(s) relative to the amount of the RNA transcript produced by the second cell(s) indicates that the compound of Formula (I) or a form thereof modulates the amount of the RNA transcript. In certain embodiments, the contacting of the cell(s) with the compound occurs in cell culture. In other embodiments, the contacting of the cell(s) with the compound occurs in a subject, such as a non-human animal subject.

In another embodiment, provided herein is a method for determining whether a compound of Formula (I) or a form thereof modulates the splicing of an RNA transcript (e.g., an mRNA transcript), comprising: (a) culturing a cell(s) in the presence of a compound of Formula (I) or a form thereof; and (b) determining the amount of the two or more RNA transcript splice variants produced by the cell(s), wherein an alteration in the amount of the two or more RNA transcript in the presence of the compound relative to the amount of the two or more RNA transcript splice variants in the absence of the compound or the presence of a negative control (e.g., a vehicle control such as PBS or DMSO) indicates that the compound of Formula (I) or a form thereof modulates the splicing of the RNA transcript.

In another embodiment, provided herein is a method for determining whether a compound of Formula (I) or a form thereof modulates the splicing of an RNA transcript (e.g., an mRNA transcript), comprising: (a) culturing a cell(s) in the presence of a compound of Formula (I) or a form thereof; (b) isolating two or more RNA transcript splice variants from the cell(s) after a certain period of time; and (c) determining the amount of the two or more RNA transcript splice variants produced by the cell(s), wherein an alteration in the amount of the two or more RNA transcript in the presence of the compound relative to the amount of the two or more RNA transcript splice variants in the absence of the compound or the presence of a negative control (e.g., a vehicle control such as PBS or DMSO) indicates that the compound of Formula (I) or a form thereof modulates the splicing of the RNA transcript. In another embodiment, provided herein is a method for determining whether a compound of Formula (I) or a form thereof modulates the splicing of an RNA transcript (e.g., an mRNA transcript), comprising (a) culturing a first cell(s) in the presence of a compound of Formula (I) or a form thereof; (b) culturing a second cell(s) in the presence of a negative control (e.g., a vehicle control, such as PBS or DMSO); (c) isolating two or more RNA transcript splice variants produced by the first cell(s) and isolating two or more RNA transcript splice variants produced by the second cell(s); (d) determining the amount of the two or more RNA transcript splice variants produced by the first cell(s) and the second cell(s); and (e) comparing the amount of the two or more RNA transcript splice variants produced by the first cell(s) to the amount of the two or more RNA transcript splice variants produced by the second cell(s), wherein an alteration in the amount of the two or more RNA transcript splice variants produced by the first cell(s) relative to the amount of the two or more RNA transcript splice variants produced by the second cell(s) indicates that the compound of Formula (I) or a form thereof modulates the aplicing of the RNA transcript.

In another embodiment, provided herein is a method for determining whether a compound of Formula (I) or a form thereof modulates the amount of an RNA transcript (e.g., an mRNA transcript), comprising: (a) contacting a cell-free system with a compound of Formula (I) or a form thereof, and (b) determining the amount of the RNA transcript produced by the cell-free system, wherein an alteration in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript. In another embodiment, provided herein is a method for determining whether a compound of Formula (I) or a form thereof modulates the amount of an RNA transcript (e.g., an mRNA transcript), comprising: (a) contacting a first cell-free system with a compound of Formula (I) or a form thereof, (b) contacting a second cell-free system with a negative control (e.g., a vehicle control, such as PBS or DMSO); and (c) determining the amount of the RNA transcript produced by the first cell-free system and the second cell-free system; and (d) comparing the amount of the RNA transcript produced by the first cell-free system to the amount of the RNA transcript expressed by the second cell-free system, wherein an alteration in the amount of the RNA transcript produced by the first cell-free system relative to the amount of the RNA transcript produced by the second cell-free system indicates that the compound of Formula (I) or a form thereof modulates the amount of the RNA transcript. In certain embodiments, the cell-free system comprises purely synthetic RNA, synthetic or recombinant (purified) enzymes, and protein factors. In other embodiments, the cell-free system comprises RNA transcribed from a synthetic DNA template, synthetic or recombinant (purified) enzymes, and protein factors. In other embodiments, the cell-free system comprises purely synthetic RNA and nuclear extract. In other embodiments, the cell-free system comprises RNA transcribed from a synthetic DNA template and nuclear extract. In other embodiments, the cell-free system comprises purely synthetic RNA and whole cell extract. In other embodiments, the cell-free system comprises RNA transcribed from a synthetic DNA template and whole cell extract. In certain embodiments, the cell-free system additionally comprises regulatory RNAs (e.g., microRNAs).

In another embodiment, provided herein is a method for determining whether a compound of Formula (I) or a form thereof modulates the splicing of an RNA transcript (e.g., an mRNA transcript), comprising: (a) contacting a cell-free system with a compound of Formula (I) or a form thereof; and (b) determining the amount of two or more RNA transcript splice variants produced by the cell-free system, wherein an alteration in the amount of the two or more RNA transcript splice variants in the presence of the compound relative to the amount of the two or more RNA transcript splice variants in the absence of the compound or the presence of a negative control (e.g., a vehicle control such as PBS or DMSO) indicates that the compound of Formula (I) or a form thereof modulates the splicing of the RNA transcript. In another embodiment, provided herein is a method for determining whether a compound of Formula (I) or a form thereof modulates the splicing of an RNA transcript (e.g., an mRNA transcript), comprising: (a) contacting a first cell-free system with a compound of Formula (I) or a form thereof; (b) contacting a second cell-free system with a negative control (e.g., a vehicle control, such as PBS or DMSO); and (c) determining the amount of two or more RNA transcript splice variants produced by the first cell-free system and the second cell-free system; and (d) comparing the amount of the two or more RNA transcript splice variants produced by the first cell-free system to the amount of the RNA transcript expressed by the second cell-free system, wherein an alteration in the amount of the two or more RNA transcript splice variants produced by the first cell-free system relative to the amount of the two or more RNA transcript splice variants produced by the second cell-free system indicates that the compound of Formula (I) or a form thereof modulates the splicing of the RNA transcript. In certain embodiments, the cell-free system comprises purely synthetic RNA, synthetic or recombinant (purified) enzymes, and protein factors. In other embodiments, the cell-free system comprises RNA transcribed from a synthetic DNA template, synthetic or recombinant (purified) enzymes, and protein factors. In other embodiments, the cell-free system comprises purely synthetic RNA and nuclear extract. In other embodiments, the cell-free system comprises RNA transcribed from a synthetic DNA template and nuclear extract. In other embodiments, the cell-free system comprises purely synthetic RNA and whole cell extract. In other embodiments, the cell-free system comprises RNA transcribed from a synthetic DNA template and whole cell extract. In certain embodiments, the cell-free system additionally comprises regulatory RNAs (e.g., microRNAs).

In another embodiment, provided herein is a method for determining whether a compound of Formula (I) or a form thereof modulates the amount of an RNA transcript (e.g., an mRNA transcript), comprising: (a) culturing a cell(s) in the presence of a compound of Formula (I) or a form thereof, (b) isolating the RNA transcript from the cell(s) after a certain period of time; and (c) determining the amount of the RNA transcript produced by the cell(s), wherein an alteration in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript. In another embodiment, provided herein is a method for determining whether a compound of Formula (I) or a form thereof modulates the amount of an RNA transcript (e.g., an mRNA transcript), comprising (a) culturing a first cell(s) in the presence of a compound of Formula (I) or a form thereof, (b) culturing a second cell(s) in the presence of a negative control (e.g., a vehicle control, such as PBS or DMSO); (c) isolating the RNA transcript produced by the first cell(s) and isolating the RNA transcript produced by the second cell(s); (d) determining the amount of the RNA transcript produced by the first cell(s) and the second cell(s); and (e) comparing the amount of the RNA transcript produced by the first cell(s) to the amount of the RNA transcript produced by the second cell(s), wherein an alteration in the amount of the RNA transcript produced by the first cell(s) relative to the amount of the RNA transcript produced by the second cell(s) indicates that the compound of Formula (I) or a form thereof modulates the amount of the RNA transcript.

In certain embodiments, the cell(s) contacted or cultured with a compound of Formula (I) or a form thereof is a primary cell(s) from a subject. In some embodiments, the cell(s) contacted or cultured with a compound of Formula (I) or a form thereof is a primary cell(s) from a subject with a disease. In specific embodiments, the cell(s) contacted or cultured with a compound of Formula (I) or a form thereof is a primary cell(s) from a subject with a disease associated with an aberrant amount of an RNA transcript(s) for a particular gene(s). In some specific embodiments, the cell(s) contacted or cultured with a compound of Formula (I) or a form thereof is a primary cell(s) from a subject with a disease associated with an aberrant amount of an isoform(s)

of a particular gene(s). In some embodiments, the cell(s) contacted or cultured with a compound of Formula (I) or a form thereof is a fibroblast (e.g., GM03813 or PNN 1-46 fibroblasts), an immune cell (e.g., a T cell, B cell, natural killer cell, macrophage), or a muscle cell. In certain embodiments, the cell(s) contacted or cultured with a compound of Formula (I) or a form thereof is a cancer cell.

In certain embodiments, the cell(s) contacted or cultured with a compound of Formula (I) or a form thereof is from a cell line. In some embodiments, the cell(s) contacted or cultured with a compound of Formula (I) or a form thereof is a cell line derived from a subject with a disease. In certain embodiments, the cell(s) contacted or cultured with a compound of Formula (I) or a form thereof is from a cell line known to have aberrant RNA transcript levels for a particular gene(s). In specific embodiments, the cell(s) contacted or cultured with a compound of Formula (I) or a form thereof is from a cell line derived from a subject with a disease known to have aberrant RNA transcript levels for a particular gene(s). In certain embodiments, the cell(s) contacted or cultured with a compound of Formula (I) or a form thereof is a cancer cell line. In some specific embodiments, the cell(s) contacted or cultured with the compound of Formula (I) or a form thereof is from a cell line derived from a subject with a disease known to have an aberrant amount of an RNA isoform(s) and/or protein isoform(s) of a particular gene(s). Non-limiting examples of cell lines include 3T3, 4T1, 721, 9L, A2780, A172, A20, A253, A431, A-549, ALC, B16, B35, BCP-1, BEAS-2B, bEnd.3, BHK, BR 293, BT2O, BT483, BxPC3, C2C12, C3H-10T1/2, C6/36, C6, Cal-27, CHO, COR-L23, COS, COV-434, CML T1, CMT, CRL7O3O, CT26, D17, DH82, DU145, DuCaP, EL4, EM2, EM3, EMT6, FM3, H1299, H69, HB54, HB55, HCA2, HDF (human dermal fibroblasts), HEK-293, HeLa, Hepa1c1c7, HL-60, HMEC, Hs578T, HsS78Bst, HT-29, HTB2, HUVEC, Jurkat, J558L, JY, K562, Ku812, KCL22, KG1, KYO1, LNCap, Ma-Mel, MC-38, MCF-7, MCF-10A, MDA-MB-231, MDA-MB-468, MDA-MB-435, MDCK, MG63, MOR/0.2R, MONO-MAC 6, MRC5, MTD-1A, NCI-H69, NIH-3T3, NALM-1, NS0, NW-145, OPCN, OPCT, PNT-1A, PNT-2, Raji, RBL, RenCa, RIN-5F, RMA, Saos-2, Sf21, Sf9, SH-SY5Y, SiHa, SKBR3, SKOV-3, T2, T-47D, T84, THP1, U373, U87, U937, VCaP, Vero, VERY, W138, WM39, WT-49, X63, YAC-1, and YAR cells. In one embodiment, the cells are from a patient. In another embodiment, the patient cells are GM03813 cells.

In another embodiment, provided herein is a method for determining whether a compound of Formula (I) or a form thereof modulates the amount of an RNA transcript (e.g., an mRNA transcript), comprising: (a) contacting a tissue sample with a compound of Formula (I) or a form thereof; and (b) determining the amount of the RNA transcript produced by the tissue sample, wherein an alteration in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript. In another embodiment, provided herein is a method for determining whether a compound of Formula (I) or a form thereof modulates the amount of an RNA transcript (e.g., an mRNA transcript), comprising: (a) contacting a first tissue sample with a compound of Formula (I) or a form thereof, (b) contacting a second tissue sample with a negative control (e.g., a vehicle control, such as PBS or DMSO); and (c) determining the amount of the RNA transcript produced by the first tissue sample and the second tissue sample; and (d) comparing the amount of the RNA transcript produced by the first tissue sample to the amount of the RNA transcript produced by the second tissue sample, wherein an alteration in the amount of the RNA transcript produced by the first tissue sample relative to the amount of the RNA transcript produced by the second tissue sample indicates that the compound of Formula (I) or a form thereof modulates the amount of the RNA transcript. Any tissue sample containing cells may be used in the accordance with these methods. In certain embodiments, the tissue sample is a blood sample, a skin sample, a muscle sample, or a tumor sample. Techniques known to one skilled in the art may be used to obtain a tissue sample from a subject.

In some embodiments, a dose-response assay is performed. In one embodiment, the dose response assay comprises: (a) contacting a cell(s) with a concentration of a compound of Formula (I) or a form thereof; (b) determining the amount of the RNA transcript produced by the cell(s), wherein an alteration in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript; (c) repeating steps (a) and (b), wherein the only experimental variable changed is the concentration of the compound or a form thereof; and (d) comparing the amount of the RNA transcript produced at the different concentrations of the compound or a form thereof. In another embodiment, the dose response assay comprises: (a) culturing a cell(s) in the presence of a compound of Formula (I) or a form thereof, (b) isolating the RNA transcript from the cell(s) after a certain period of time; (c) determining the amount of the RNA transcript produced by the cell(s), wherein an alteration in the amount of the RNA transcript in the presence of the compound relative to the amount of the RNA transcript in the absence of the compound or the presence of a negative control (e.g., a vehicle control such as PBS or DMSO) indicates that the compound of Formula (I) or a form thereof modulates the amount of the RNA transcript; (d) repeating steps (a), (b), and (c), wherein the only experimental variable changed is the concentration of the compound or a form thereof; and (e) comparing the amount of the RNA transcript produced at the different concentrations of the compound or a form thereof. In another embodiment, the dose-response assay comprises: (a) contacting each well of a microtiter plate containing cells with a different concentration of a compound of Formula (I) or a form thereof; (b) determining the amount of an RNA transcript produced by cells in each well; and (c) assessing the change of the amount of the RNA transcript at the different concentrations of the compound or form thereof.

In one embodiment, the dose response assay comprises: (a) contacting a cell(s) with a concentration of a compound of Formula (I) or a form thereof, wherein the cells are within the wells of a tissue culture container (e.g., a 96-well plate) at about the same density within each well, and wherein the cells are contacted with different concentrations of compound in different wells; (b) isolating the RNA from said cells in each well; (c) determining the amount of the RNA transcript produced by the cell(s) in each well; and (d) assessing change in the amount of the RNA transcript in the presence of one or more concentrations of compound relative to the amount of the RNA transcript in the presence of a different concentration of the compound or the absence of the compound or the presence of a negative control (e.g., a vehicle control such as PBS or DMSO).

In certain embodiments, the contacting of the cell(s) with the compound occurs in cell culture. In other embodiments, the contacting of the cell(s) with the compound occurs in a subject, such as a non-human animal subject.

In certain embodiments described herein, the cell(s) is contacted or cultured with a compound of Formula (I) or a form thereof, or a tissue sample is contacted with a compound of Formula (I) or a form thereof, or a negative control for a period of 15 minutes, 30 minutes, 45 minutes, 1 hour, 2 hours, 3 hours, 4 hours, 5 hours, 6 hours, 8 hours, 12 hours, 18 hours, 24 hours, 48 hours, 72 hours or more. In other embodiments described herein, the cell(s) is contacted or cultured with a compound of Formula (I) or a form thereof, or a tissue sample is contacted with a compound of Formula (I) or a form thereof, or a negative control for a period of 15 minutes to 1 hour, 1 to 2 hours, 2 to 4 hours, 6 to 12 hours, 12 to 18 hours, 12 to 24 hours, 28 to 24 hours, 24 to 48 hours, 48 to 72 hours.

In certain embodiments described herein, the cell(s) is contacted or cultured with a certain concentration of a compound of Formula (I) or a form thereof, or a tissue sample is contacted with a certain concentration of a compound of Formula (I) or a form thereof, wherein the certain concentration is 0.0001 µM, 0.0003 µM, 0.001 µM, 0.003 µM, 0.01 µM, 0.05 µM, 1 µM, 2 µM, 5 µM, 10 µM, 15 µM, 20 µM, 25 µM, 50 µM, 75 µM, 100 µM, or 150 µM. In other embodiments described herein, the cell(s) is contacted or cultured with a certain concentration of a compound of Formula (I) or a form thereof, or a tissue sample is contacted with a certain concentration of a compound of Formula (I) or a form thereof, wherein the certain concentration is 0.0001 µM, 0.0003 µM, 0.0005 µM, 0.001 µM, 0.003 µM, 0.005 µM, 0.01 µM, 0.03 µM, 0.05 µM, 0.1 µM, 0.3 µM, 0.5 µM or 1 µM. In other embodiments described herein, the cell(s) is contacted or cultured with a certain concentration of a compound of Formula (I) or a form thereof, or a tissue sample is contacted with a certain concentration of a compound of Formula (I) or a form thereof, wherein the certain concentration is 175 µM, 200 µM, 250 µM, 275 µM, 300 µM, 350 µM, 400 µM, 450 µM, 500 µM, 550 µM 600 µM, 650 µM, 700 µM, 750 µM, 800 µM, 850 µM, 900 µM, 950 µM or 1 mM. In some embodiments described herein, the cell(s) is contacted or cultured with a certain concentration of a compound of Formula (I) or a form thereof, or a tissue sample is contacted with a certain concentration of a compound of Formula (I) or a form thereof, wherein the certain concentration is 5 nM, 10 nM, 20 nM, 30 nM, 40 nM, 50 nM, 60 nM, 70 nM, 80 nM, 90 nM, 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, or 950 nM. In certain embodiments described herein, the cell(s) is contacted or cultured with a certain concentration of a compound of Formula (I) or a form thereof, or a tissue sample is contacted with a certain concentration of a compound of Formula (I) or a form thereof, wherein the certain concentration is between 0.0001 µM to 0.001 µM, 0.0001 µM to 0.01 µM, 0.0003 µM to 0.001 µM, 0.0003 µM to 0.01 µM, 0.001 µM to 0.01 µM, 0.003 µM to 0.01 µM, 0.01 µM to 0.1 µM, 0.1 µM to 1 µM, 1 µM to 50 µM, 50 µM to 100 µM, 100 µM to 500 µM, 500 µM to 1 nM, 1 nM to 10 nM, 10 nM to 50 nM, 50 nM to 100 nM, 100 nM to 500 nM, 500 nM to 1000 nM.

In another embodiment, provided herein is a method for determining whether a compound of Formula (I) or a form thereof modulates the amount of an RNA transcript (e.g., an mRNA transcript), comprising: (a) administering a compound of Formula (I) or a form thereof to a subject (in certain embodiments, a non-human animal); and (b) determining the amount of the RNA transcript in a sample obtained from the subject, wherein an alteration in the amount of the RNA transcript measured in the sample from the subject administered the compound or form thereof relative to the amount of the RNA transcript in a sample from the subject prior to administration of the compound or form thereof or a sample from a different subject from the same species not administered the compound or form thereof indicates that the compound of Formula (I) or a form thereof modulates the amount of the RNA transcript. In another embodiment, provided herein is a method for determining whether a compound of Formula (I) or a form thereof modulates the amount of an RNA transcript (e.g., an mRNA transcript), comprising: (a) administering a compound of Formula (I) or a form thereof to a first subject (in certain embodiments, a non-human animal); (b) administering a negative control (e.g., a pharmaceutical carrier) to a second subject (in certain embodiments, a non-human animal) of the same species as the first subject; and (c) determining the amount of the RNA transcript in a first tissue sample from the first subject and the amount of the RNA transcript in the second tissue sample from the second subject; and (d) comparing the amount of the RNA transcript in the first tissue sample to the amount of the RNA transcript in the second tissue sample, wherein an alteration in the amount of the RNA transcript in the first tissue sample relative to the amount of the RNA transcript in the second tissue sample indicates that the compound of Formula (I) or a form thereof modulates the amount of the RNA transcript. In certain embodiments, a compound of Formula (I) or form thereof is administered to a subject at a dose of about 0.001 mg/kg/day to about 500 mg/kg/day. In some embodiments, a single dose of a compound of Formula (I) or a form thereof is administered to a subject in accordance with the methods described herein. In other embodiments, 2, 3, 4, 5 or more doses of a compound of Formula (I) is administered to a subject in accordance with the methods described herein. In specific embodiments, the compound of Formula (I) or a form thereof is administered in a subject in a pharmaceutically acceptable carrier, excipient or diluent.

In another embodiment, provided herein is a method for determining whether a compound of Formula (I) or a form thereof modulates the splicing of an RNA transcript (e.g., an mRNA transcript), comprising: (a) administering a compound of Formula (I) or a form thereof to a subject (in certain embodiments, a non-human animal); and (b) determining the amount of two or more RNA transcript splice variants in a sample obtained from the subject, wherein an alteration in the amount of the two or more RNA transcript splice variants measured in the sample from the subject administered the compound or form thereof relative to the amount of the two or more RNA transcript splice variants in a sample from the subject prior to administration of the compound or form thereof or a sample from a different subject from the same species not administered the compound or form thereof indicates that the compound of Formula (I) or a form thereof modulates the splicing of the RNA transcript. In another embodiment, provided herein is a method for determining whether a compound of Formula (I) or a form thereof modulates the splicing of an RNA transcript (e.g., an mRNA transcript), comprising: (a) administering a compound of Formula (I) or a form thereof to a first subject (in certain embodiments, a non-human animal); (b) administering a negative control (e.g., a pharmaceutical carrier) to a second subject (in certain embodiments, a non-human animal) of the same species as the first subject; and (c) determining the amount of two or more RNA transcript splice variants in a first tissue sample from the first subject and the amount of two or more RNA transcript splice variants in the second tissue sample from the second subject; and (d) comparing the amount of the two or more RNA transcript splice variants in the first tissue sample to the amount of the two or more RNA transcript splice variants in the second tissue sample, wherein an alteration in the amount of the two or more RNA transcript splice variants in the first tissue sample relative to the amount of the two or more RNA transcript splice variants in the second tissue sample indicates that the compound of Formula (I) or a form thereof modulates the splicing of the RNA transcript. In certain embodiments, a compound of Formula (I) or form thereof is administered to a subject at a dose of about 0.001 mg/kg/day to about 500 mg/kg/day. In some embodiments, a single dose of a compound of Formula (I) or a form thereof is administered to a subject in accordance with the methods described herein. In other embodiments, 2, 3, 4, 5 or more doses of a compound of Formula (I) is administered to a subject in accordance with the methods described herein. In specific embodiments, the compound of Formula (I) or a form thereof is administered in a subject in a pharmaceutically acceptable carrier, excipient or diluent.

In some embodiments, the compound of Formula (I) or a form thereof that is contacted or cultured with a cell(s) or a tissue sample, or administered to a subject is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV). In some embodiments, the compound of Formula (I) or a form thereof that is contacted or cultured with a cell(s) or a tissue sample, or administered to a subject is a compound described herein.

Techniques known to one skilled in the art may be used to determine the amount of an RNA transcript(s). In some embodiments, the amount of one, two, three or more RNA transcripts is measured using deep sequencing, such as ILLUMINA® RNASeq, ILLUMINA® next generation sequencing (NGS), ION TORRENT™ RNA next generation sequencing, 454™ pyrosequencing, or Sequencing by Oligo Ligation Detection (SOLID™). In other embodiments, the amount of multiple RNA transcripts is measured using an exon array, such as the GENECHIP® human exon array. In certain embodiments, the amount of one, two, three or more RNA transcripts is determined by RT-PCR. In other embodiments, the amount of one, two, three or more RNA transcripts is measured by RT-qPCR or digital color-coded barcode technology. Techniques for conducting these assays are known to one skilled in the art.

In some embodiments, analysis is performed on data derived from the assay to measure the magnitude of splicing to determine the amount of exons spliced into an mRNA transcript that is produced in the presence of the compound relative to the amount in the absence of the compound or presence of a negative control. In a preferred embodiment, the method utilized is calculation of change in Percent Spliced In (ΔPSI). The method utilizes read data from RNAseq (or any other method that can distinguish mRNA splice isoforms) to calculate the ratio (percentage) between reads that either demonstrate inclusion (junctions between the upstream exon and the exon of interest) or exclusion (junction between the upstream and downstream exons, excluding the exon of interest), to demonstrate whether the presence of the compound affects the amount of exon inclusion relative to the amount of inclusion in the absence of the compound or the presence of a negative control.

The ΔPSI value is derived from the formula:

$$\Delta PSI(\%) = \{(a+b)/2/[(a+b)/2+c]\}^C - \{(a+b)/2/[(a+b)/2+c]\}^U \times 100$$

Where "U" represents the value for probability of iExon inclusion $(a+b)/2/[(a+b)/2+c]^U$ in the absence of the compound; and, where "C" represents the value for probability of iExon inclusion $(a+b)/2/[(a+b)/2+c]^C$ in the presence of the compound. The values for "a" and "b" represent the number of reads supporting inclusion of an iExon in an RNA transcript. In other words, the "a" value is derived from the amount of reads for a first intronic nucleotide sequence comprising, in 5' to 3' order: a first exon having a 5' splice site operably linked and upstream from a first intronic nucleotide sequence comprising a first branch point further operably linked and upstream from a first intronic 3' splice site (upstream of the nascent iExon). The "b" value is derived from the amount of reads for a second intronic nucleotide sequence comprising, in 5' to 3' order: an iREMS sequence operably linked downstream from the first intronic 3' splice site and upstream from a second intronic nucleotide sequence comprising a second branch point further operably linked and upstream from a second intronic 3' splice site of a second exon. The value for "c" represents the number of reads supporting exclusion of an iExon. Accordingly, when a compound enables the splicing machinery to recognize a nascent iExon, the value for $(a+b)/2/[(a+b)/2+c]^C$ in the presence of the splicing modifier compound will differ from the value for $(a+b)/2/[(a+b)/2+c]^U$ in the absence of the compound. The statistically significant value for the likelihood of iExon inclusion may be obtained according to statistical analysis methods or other probability analysis methods known to those of ordinary skill in the art.

In some embodiments, a statistical analysis or other probability analysis is performed on data from the assay utilized to measure an RNA transcript. In certain embodiments, for example, a Fisher's Exact Test statistical analysis is performed by comparing the total number of reads for the inclusion and exclusion of an iExon (or region) based on data from one or more assays used to measure whether the amount of an RNA transcript is altered in the presence of the compound relative to the amount in the absence of the compound or presence of a negative control. In specific embodiments, the statistical analysis results in a confidence value for those RNA transcripts with the alternation of 10%, 5%, 4%, 3%, 2%, 1%, 0.5%, 0.1%, 0.01%, 0.001% or 0.0001%. In some specific embodiments, the confidence value is a p value of those altered RNA transcripts of is 10%, 5%, 4%, 3%, 2%, 1%, 0.5%, 0.1%, 0.01%, 0.001% or 0.0001%. In certain specific embodiments, an exact test, student t-test or p value of those RNA transcripts with the alteration is 10%, 5%, 4%, 3%, 2%, 1%, 0.5% or 0.1% and 10%, 5%, 4%, 3%, 2%, 1%, 0.5%, 0.1%, 0.01%, 0.001% or 0.0001%, respectively.

In certain embodiments, a further analysis is performed to determine how the compound of Formula (I) or a form thereof is changing the amount of an RNA transcript(s). In specific embodiments, a further analysis is performed to determine if an alternation in the amount of an RNA transcript(s) in the presence of a compound of Formula (I) or a form thereof relative the amount of the RNA transcript(s) in the absence of the compound or a form thereof, or the presence of a negative control is due to changes in transcription, splicing, and/or stability of the RNA transcript(s). Techniques known to one skilled in the art may be used to determine whether a compound of Formula (I) or a form thereof changes, e.g., the transcription, splicing and/or stability of an RNA transcript(s).

In certain embodiments, the stability of one or more RNA transcripts is determined by serial analysis of gene expression (SAGE), differential display analysis (DD), RNA arbitrary primer (RAP)-PCR, restriction endonuclease-lytic analysis of differentially expressed sequences (READS), amplified restriction fragment-length polymorphism (ALFP), total gene expression analysis (TOGA), RT-PCR, RT-qPCR, RNA-Seq, digital color-coded barcode technology, high-density cDNA filter hybridization analysis (HDFCA), suppression subtractive hybridization (SSH), differential screening (DS), cDNA arrays, oligonucleotide chips, or tissue microarrays. In other embodiments, the stability of one or more RNA transcripts is determined by Northern blot, RNase protection, or slot blot.

In some embodiments, the transcription in a cell(s) or tissue sample is inhibited before (e.g., 5 minutes, 10 minutes, 30 minutes, 1 hour, 2 hours, 4 hours, 6 hours, 8 hours, 12 hours, 18 hours, 24 hours, 36 hours, 48 hours, or 72 hours before) or after (e.g., 5 minutes, 10 minutes, 30 minutes, 1 hour, 2 hours, 4 hours, 6 hours, 8 hours, 12 hours, 18 hours, 24 hours, 36 hours, 48 hours, or 72 hours after) the cell or the tissue sample is contacted or cultured with an inhibitor of transcription, such as α-amanitin, DRB, flavopiridol, triptolide, or actinomycin-D. In other embodiments, the transcription in a cell(s) or tissue sample is inhibited with an inhibitor of transcription, such as α-amanitin, DRB, flavopiridol, triptolide, or actinomycin-D, while the cell(s) or tissue sample is contacted or cultured with a compound of Formula (I) or a form thereof.

In certain embodiments, the level of transcription of one or more RNA transcripts is determined by nuclear run-on assay or an in vitro transcription initiation and elongation assay. In some embodiments, the detection of transcription is based on measuring radioactivity or fluorescence. In some embodiments, a PCR-based amplification step is used.

In specific embodiments, the amount of alternatively spliced forms of the RNA transcripts of a particular gene are measured to see if there is an alteration in the amount of one, two or more alternatively spliced forms of the RNA transcripts of the gene. In some embodiments, the amount of an isoform(s) encoded by a particular gene is measured to see if there is an alteration in the amount of the isoform(s). In certain embodiments, the levels of spliced forms of RNA are quantified by RT-PCR, RT-qPCR, RNA-Seq, digital color-coded barcode technology, or Northern blot. In other embodiments, sequence-specific techniques may be used to detect the levels of an individual spliceoform. In certain embodiments, splicing is measured in vitro using nuclear extracts. In some embodiments, detection is based on measuring radioactivity or fluorescence. Techniques known to one skilled in the art may be used to measure alterations in the amount of alternatively spliced forms of an RNA transcript of a gene and alterations in the amount of an isoform encoded by a gene. In a specific embodiment, modulation of RNA transcripts is assessed as described in the Examples described herein.

Also provided herein are methods of screening for new compounds that can be used to modulate the amount of a product (e.g., a precursor RNA, an mRNA, or protein) of a gene comprising an intronic REMS in its DNA or RNA sequence. The methods described above in this section with respect to determining whether the amount of a product (e.g., a precursor RNA, an mRNA, or protein) of a gene is likely to be modulated by a compound of Formula (I) or a form thereof can be also used in the methods of screening for new compounds. In a specific embodiment, the method comprises contacting a candidate compound with an RNA transcript, wherein the RNA transcript comprises exons and one or more introns, wherein at least one intron comprises, in 5' to 3' order, a branch point, a 3' splice site, and an intronic REMS. In another specific embodiment, the method comprises contacting a candidate compound with an RNA transcript, wherein the RNA transcript comprises exons and one or more introns, wherein at least one intron comprises an intronic REMS downstream of a branch point and a 3' splice site. The RNA transcript may be present in a cell or cell lysate. The methods described above regarding the techniques of contacting a compound with an RNA transcript, the dosage, etc., may be used in the methods of screening. The candidate compounds to be screened can be provided by any source. For example, the candidate compounds to be screened can be from a compound library, such as a commercial compound library.

Pharmaceutical Compositions and Modes of Administration

When administered to a patient, a compound of Formula (I) or a form thereof is preferably administered as a component of a composition that optionally comprises a pharmaceutically acceptable carrier, excipient or diluent. The composition can be administered orally, or by any other convenient route, for example, by infusion or bolus injection, by absorption through epithelial or mucocutaneous linings (e.g., oral mucosa, rectal, and intestinal mucosa) and may be administered together with another biologically active agent. Administration can be systemic or local. Various delivery systems are known, e.g., encapsulation in liposomes, microparticles, microcapsules, capsules, and can be used to administer the compound.

Methods of administration include, but are not limited to, parenteral, intradermal, intramuscular, intraperitoneal, intravenous, subcutaneous, intranasal, epidural, oral, sublingual, intranasal, intraocular, intratumoral, intracerebral, intravaginal, transdermal, ocularly, rectally, by inhalation, or topically, particularly to the ears, nose, eyes, or skin. The mode of administration is left to the discretion of the practitioner. In most instances, administration will result in the release of a compound into the bloodstream, tissue or cell(s). In a specific embodiment, a compound is administered orally.

The amount of a compound of Formula (I) or a form thereof that will be effective in the treatment of a disease resulting from an aberrant amount of mRNA transcripts depends, e.g., on the route of administration, the disease being treated, the general health of the subject, ethnicity, age, weight, and gender of the subject, diet, time, and the severity of disease progress, and should be decided according to the judgment of the practitioner and each patient's or subject's circumstances.

In specific embodiments, an "effective amount" in the context of the administration of a compound of Formula (I) or a form thereof, or composition or medicament thereof refers to an amount of a compound of Formula (I) or a form thereof to a patient which has a therapeutic effect and/or beneficial effect. In certain specific embodiments, an "effective amount" in the context of the administration of a compound of Formula (I) or a form thereof, or composition or medicament thereof to a patient results in one, two or more of the following effects: (i) reduces or ameliorates the severity of a disease; (ii) delays onset of a disease; (iii) inhibits the progression of a disease; (iv) reduces hospitalization of a subject; (v) reduces hospitalization length for a subject; (vi) increases the survival of a subject; (vii)

improves the quality of life of a subject; (viii) reduces the number of symptoms associated with a disease; (ix) reduces or ameliorates the severity of a symptom(s) associated with a disease; (x) reduces the duration of a symptom associated with a disease associated; (xi) prevents the recurrence of a symptom associated with a disease; (xii) inhibits the development or onset of a symptom of a disease; and/or (xiii) inhibits of the progression of a symptom associated with a disease. In certain embodiments, an effective amount of a compound of Formula (I) or a form thereof is an amount effective to restore the amount of a RNA transcript of a gene to the amount of the RNA transcript detectable in healthy patients or cells from healthy patients. In other embodiments, an effective amount of a compound of Formula (I) or a form thereof is an amount effective to restore the amount an RNA isoform and/or protein isoform of gene to the amount of the RNA isoform and/or protein isoform detectable in healthy patients or cells from healthy patients.

In certain embodiments, an effective amount of a compound of Formula (I) or a form thereof is an amount effective to decrease the aberrant amount of an RNA transcript of a gene which associated with a disease. In certain embodiments, an effective amount of a compound of Formula (I) or a form thereof is an amount effective to decrease the amount of the aberrant expression of an isoform of a gene. In some embodiments, an effective amount of a compound of Formula (I) or a form thereof is an amount effective to result in a substantial change in the amount of an RNA transcript (e.g., mRNA transcript), alternative splice variant or isoform.

In certain embodiments, an effective amount of a compound of Formula (I) or a form thereof is an amount effective to increase or decrease the amount of an RNA transcript (e.g., an mRNA transcript) of gene which is beneficial for the prevention and/or treatment of a disease. In certain embodiments, an effective amount of a compound of Formula (I) or a form thereof is an amount effective to increase or decrease the amount of an alternative splice variant of an RNA transcript of gene which is beneficial for the prevention and/or treatment of a disease. In certain embodiments, an effective amount of a compound of Formula (I) or a form thereof is an amount effective to increase or decrease the amount of an isoform of gene which is beneficial for the prevention and/or treatment of a disease. Non-limiting examples of effective amounts of a compound of Formula (I) or a form thereof are described herein.

For example, the effective amount may be the amount required to prevent and/or treat a disease associated with the aberrant amount of an mRNA transcript of gene in a human subject.

In general, the effective amount will be in a range of from about 0.001 mg/kg/day to about 500 mg/kg/day for a patient having a weight in a range of between about 1 kg to about 200 kg. The typical adult subject is expected to have a median weight in a range of between about 70 and about 100 kg.

Within the scope of the present description, the "effective amount" of a compound of Formula (I) or a form thereof for use in the manufacture of a medicament, the preparation of a pharmaceutical kit or in a method for preventing and/or treating a disease in a human subject in need thereof, is intended to include an amount in a range of from about 0.001 mg to about 35,000 mg.

The compositions described herein are formulated for administration to the subject via any drug delivery route known in the art. Non-limiting examples include oral, ocular, rectal, buccal, topical, nasal, ophthalmic, subcutaneous, intramuscular, intraveneous (bolus and infusion), intracerebral, transdermal, and pulmonary routes of administration.

Embodiments described herein include the use of a compound of Formula (I) or a form thereof in a pharmaceutical composition. In a specific embodiment, described herein is the use of a compound of Formula (I) or a form thereof in a pharmaceutical composition for preventing and/or treating a disease in a human subject in need thereof comprising administering an effective amount of a compound of Formula (I) or a form thereof in admixture with a pharmaceutically acceptable carrier, excipient or diluent. In a specific embodiment, the human subject is a patient with a disease associated with the aberrant amount of an mRNA transcript(s).

A compound of Formula (I) or a form thereof may optionally be in the form of a composition comprising the compound or a form thereof and an optional carrier, excipient or diluent. Other embodiments provided herein include pharmaceutical compositions comprising an effective amount of a compound of Formula (I) or a form thereof and a pharmaceutically acceptable carrier, excipient, or diluent. In a specific embodiment, the pharmaceutical compositions are suitable for veterinary and/or human administration. The pharmaceutical compositions provided herein can be in any form that allows for the composition to be administered to a subject.

In a specific embodiment and in this context, the term "pharmaceutically acceptable carrier, excipient or diluent" means a carrier, excipient or diluent approved by a regulatory agency of the Federal or a state government or listed in the U.S. Pharmacopeia or other generally recognized pharmacopeia for use in animals, and more particularly in humans. The term "carrier" refers to a diluent, adjuvant (e.g., Freund's adjuvant (complete and incomplete)), excipient, or vehicle with which a therapeutic agent is administered. Such pharmaceutical carriers can be sterile liquids, such as water and oils, including those of petroleum, animal, vegetable or synthetic origin, such as peanut oil, soybean oil, mineral oil, sesame oil and the like. Water is a specific carrier for intravenously administered pharmaceutical compositions. Saline solutions and aqueous dextrose and glycerol solutions can also be employed as liquid carriers, particularly for injectable solutions.

Typical compositions and dosage forms comprise one or more excipients. Suitable excipients are well-known to those skilled in the art of pharmacy, and non limiting examples of suitable excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. Whether a particular excipient is suitable for incorporation into a pharmaceutical composition or dosage form depends on a variety of factors well known in the art including, but not limited to, the way in which the dosage form will be administered to a patient and the specific active ingredients in the dosage form. Further provided herein are anhydrous pharmaceutical compositions and dosage forms comprising one or more compounds of Formula (I) or a form thereof as described herein. The compositions and single unit dosage forms can take the form of solutions or syrups (optionally with a flavoring agent), suspensions (optionally with a flavoring agent), emulsions, tablets (e.g., chewable tablets), pills, capsules, granules, powder (optionally for reconstitution), taste-masked or sustained-release formulations and the like.

Pharmaceutical compositions provided herein that are suitable for oral administration can be presented as discrete dosage forms, such as, but are not limited to, tablets, caplets, capsules, granules, powder, and liquids. Such dosage forms contain predetermined amounts of active ingredients, and may be prepared by methods of pharmacy well known to those skilled in the art.

Examples of excipients that can be used in oral dosage forms provided herein include, but are not limited to, binders, fillers, disintegrants, and lubricants.

Methods of Modulating the Amount of RNA Transcripts Encoded by Certain Genes

In one aspect, described herein are methods for modulating the amount of a product of a gene, wherein a precursor RNA transcript transcribed from the gene contains an intronic REMS, and the methods utilize a compound described herein. In certain embodiments, the gene contains a nucleotide sequence encoding an endogenous intronic REMS. In a specific embodiment, the precursor RNA transcript further contains a branch point and a 3' splice site upstream from the intronic REMS. In certain embodiments, the gene is any one of the genes disclosed in Tables 2-7 or 1. In certain embodiments, the gene contains a nucleotide sequence encoding a non-endogenous intronic REMS. In one embodiment, provided herein are methods for modulating the amount of one, two, three or more RNA transcripts of a gene, by way of nonlimiting example, disclosed in Tables 2-7 or 1, infra, the method comprising contacting a cell with a compound of Formula (I) or a form thereof.

In another embodiment, provided herein is a method for modulating the amount of a product of a gene (such as an RNA transcript or a protein), wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, an iREMS, a nucleotide sequence encoding a second branch point and a nucleotide sequence encoding a second 3' splice site, wherein the iREMS comprises a DNA sequence GAgtrngn (SEQ ID NO: 4), and wherein r is adenine or guanine and n is any nucleotide, the method comprising contacting a cell with a compound described herein (for example, a compound of Formula (I) or a form thereof).

In another embodiment, provided herein is a method for modulating the amount of a product of a gene (such as an RNA transcript or protein), wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence of the intron comprises in 5' to 3' order: an iREMS, a nucleotide sequence encoding a first branch point and a nucleotide sequence encoding a first 3' splice site, wherein the iREMS comprises a DNA sequence GAgtrngn (SEQ ID NO: 4), and wherein r is adenine or guanine and n is any nucleotide, the method comprising contacting a cell with a compound described herein (for example, a compound of Formula (I) or a form thereof).

In another embodiment, provided herein is a method for modulating the amount of a product of a gene (such as an RNA transcript or protein), wherein the gene comprises a DNA nucleotide sequence encoding two exons and an intron, and wherein the DNA nucleotide sequence comprises exonic and intronic elements illustrated in FIG. 1A, the method comprising contacting a cell with a compound described herein.

In another embodiment, provided herein is a method for modulating the amount of a product of a gene (such as an RNA transcript or protein), wherein the gene comprises a DNA nucleotide sequence encoding two exons and an intron, and wherein the DNA nucleotide sequence comprises exonic and intronic elements illustrated in FIG. 1B, the method comprising contacting a cell with a compound described herein.

In another embodiment, provided herein is a method for modulating the amount of a product of a gene (such as an RNA transcript or protein), wherein the gene comprises a DNA nucleotide sequence encoding two exons and an intron, and wherein the DNA nucleotide sequence comprises exonic and intronic elements illustrated in FIG. 1C, the method comprising contacting a cell with a compound described herein.

In a specific embodiment, the gene is a gene described in a table in this disclosure.

In another embodiment, provided herein are methods for modulating the amount of one, two, three or more RNA transcripts of a gene, disclosed in Tables 2-7, infra, wherein the precursor transcript transcribed from the gene comprises an intronic REMS, the method comprising contacting a cell with a compound of Formula (I) or a form thereof.

In another embodiment, provided herein are methods for modulating the amount of one, two, three or more RNA transcripts of a gene, disclosed in International Patent Application No. PCT/US2014/071252 (International Publication No. WO 2015/105657), wherein the precursor transcript transcribed from the gene comprises an intronic REMS, the method comprising contacting a cell with a compound of Formula (I) or a form thereof. In another embodiment, provided herein are methods for modulating the amount of one, two, three or more RNA transcripts of a gene, disclosed in International Patent Application No. PCT/US2016/034864 (International Publication No. WO 2016/196386), wherein the precursor transcript transcribed from the gene comprises an intronic REMS, the method comprising contacting a cell with a compound of Formula (I) or a form thereof. In a specific embodiment, the precursor RNA transcript further contains a branch point and a 3' splice site upstream from the intronic REMS.

In certain embodiments, the gene is a gene not disclosed in either International Publication No. WO 2015/105657, International Publication No. WO 2016/196386, or both.

In another embodiment, provided herein are methods for modulating the amount of one, two, three or more RNA transcripts of a gene, disclosed in Table 1, infra, wherein the precursor transcript transcribed from the gene comprises an intronic REMS, the method comprising contacting a cell with a compound of Formula (I) or a form thereof. In a specific embodiment, the precursor RNA transcript further contains a branch point and a 3' splice site upstream from the intronic REMS.

In another embodiment, provided herein are methods for modulating the amount of one, two, three or more RNA transcripts of a gene, disclosed in Table 7, infra, comprising contacting a cell with a compound of Formula (I) or a form thereof. See the example section for additional information regarding the genes in Table 7. In certain embodiments, the cell is contacted with the compound of Formula (I) or a form thereof in a cell culture. In other embodiments, the cell is contacted with the compound of Formula (I) or a form thereof in a subject (e.g., a non-human animal subject or a human subject). In a specific embodiment, the RNA transcript contains in 5' to 3' order: a branch point, a 3' splice site and an intronic REMS.

In one aspect, provided herein is a method for producing a mature mRNA transcript comprising iExon from a pre-mRNA transcript, wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide. In one embodiment, provided herein is a method for producing a mature mRNA transcript comprising an iExon, the method comprising contacting a pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide. In another embodiment, provided herein is a method for producing a mature mRNA transcript comprising an iExon, the method comprising contacting a cell or cell lysate containing a pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous or non-endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide. In some embodiments, the pre-mRNA transcript is encoded by a gene disclosed herein (e.g., in a table herein).

In a particular embodiment, provided herein is a method for producing a mature mRNA transcript comprising an iExon, the method comprising contacting a pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide, wherein the pre-mRNA transcript is a pre-mRNA transcript of a gene that is selected from ABCB8, ABCC3, ADAM17, ADCY3, AGPAT4, ANKRA2, APIP, APPL2, ARHGAP1, ARL15, ASAP1, ASPH, ATAD2B, ATXN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, ENOX1, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPA1, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 or ZNF37BP. In another particular embodiment, provided herein is a method for producing a mature mRNA transcript comprising an iExon, the method comprising contacting a cell or cell lysate containing a pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous intronic recognition element for splicing modifier (iREMS), a second branch point, and a second 3' splice site, wherein the iREMS comprises an RNA sequence GAgurngn (SEQ ID NO: 2), wherein r is adenine or guanine and n is any nucleotide, wherein the pre-mRNA transcript is a pre-mRNA transcript of a gene that is selected from ABCB8, ABCC3, ADAM17, ADCY3, AGPAT4, ANKRA2, ANXA11, APIP, APPL2, ARHGAP1, ARL15, ASAP1, ASPH, ATAD2B, ATXN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, ENOX1, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPA1, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 or ZNF37BP.

In another aspect, provided herein is a method modulating the amount of a mature mRNA transcript produced by a pre-mRNA transcript, wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous or non-endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide. In one embodiment, provided herein is a method for modulating the amount of a mature mRNA transcript produced by a pre-mRNA transcript, the method comprising contacting the pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous or non-endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide. In another embodiment, provided herein is a method for modulating the amount of a mature mRNA transcript produced by a pre-mRNA transcript, the method comprising contacting a cell or cell lysate containing the pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous or non-endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide. In some embodiments, the intron further comprises a first 5' splice site, a second branch point, and a second 3' splice site upstream of the iREMS. In some embodiments, the pre-mRNA transcript is encoded by a gene disclosed herein (e.g., in a table herein).

In a particular embodiment, provided herein is a method for modulating the amount of a mature mRNA transcript produced by a pre-mRNA transcript, the method comprising contacting the pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide, and wherein the pre-mRNA transcript is a pre-mRNA transcript of a gene that is selected from ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837. In a particular embodiment, provided herein is a method for modulating the amount of a mature mRNA transcript produced by a pre-mRNA transcript, the method comprising contacting a cell or cell lysate containing the pre-mRNA transcript with a compound described herein (e.g., a compound of Formula (I) or a form thereof), wherein the pre-mRNA transcript comprises two exons and an intron, wherein one exon is upstream of the intron and the other exon is downstream of the intron, wherein the intron comprises a RNA nucleotide sequence comprising in 5' to 3' order: an endogenous intronic recognition element for splicing modifier (iREMS), a first branch point, and a first 3' splice site, wherein the iREMS comprises an RNA sequence GAgurngn (SEQ ID NO: 2), wherein r is adenine or guanine and n is any nucleotide, and wherein the pre-mRNA transcript is a pre-mRNA transcript of a gene that is selected from ABCA10, ABCB8, ABCC3, ACTA2, ADAL, ADAMTS1, ADCY3, ADD1, ADGRG6, ADH6, ADHFE1, AFF3, AGPAT4, AKAP3, ANK1, ANK3, ANKRA2, ANKRD33B, ANKRD36, AP4B1-AS1, APIP, ARHGAP1, ARHGAP12, ARHGEF16, ARID5B, ARL15, ARL9, ARMCX6, ASIC1, ATG5, ATP2A3, ATXN1, B3GALT2, B3GNT6, BCL2L15, BCYRN1, BECN1, BHMT2, BIN3-IT1, BIRC3, BIRC6, BTG2, BTN3A1, C10orf54, C11orf70, C11orf94, C12orf4, C12orf56, C14orf132, C19orf47, C1orf86, C3, C7orf31, C8orf34, C8orf44, C8orf44-SGK3, C8orf88, CA13, CA3, CACNA2D2, CACNB1, CADM1, CAND2, CASP7, CCDC122, CCDC79, CCER2, CCNF, CECR7, CELSR1, CEMIP, CENPI, CEP112, CEP170, CEP192, CFH, CHEK1, CIITA, CLDN23, CLTA, CMAHP, CNGA4, CNRIP1, CNTD1, COL11A1, COL14A1, COL15A1, COL5A1, COL5A3, COL6A6, COL8A1, COLEC12, COMP, CPA4, CPQ, CPSF4, CRISPLD2, CRLF1, CRYBG3, CRYL1, CSNK1E, CSNK1G1, CYB5R2, CYGB, CYP1B1, DAGLB, DCAF17, DCLK1, DCN, DDIT4L, DDX50, DEGS1, DEPTOR, DFNB59, DIRAS3, DLG5, DLGAP4, DNAH8, DNAJC13, DNAJC27, DNMBP, DOCK11, DYNC1I1, DYRK1A, DZIP1L, EFEMP1, EGR3, ELN, ELP4, EMX2OS, ENAH, ENPP1, EP300, ERCC1, ERCC8, ERGIC3, ERLIN2, ERRFI1, ESM1, EVC, EVC2, F2R, FAIM, FAM126A, FAM13A, FAM160A1, FAM162A, FAM174A, FAM20A, FAM46B, FAM65B, FAP, FARP1, FBLN2, FBN2, FBXL6, FCHO1, FGFR2, FGL2, FLT1, FRAS1, FSCN2, GAL3ST4, GALNT15, GATA6, GBGT1, GCNT1, GDF6, GGACT, GLCE, GNAQ, GPR183, GPR50, GPRC5A, GPRC5B, GRTP1, GUCA1B, GULP1, GXYLT1, HAPLN1, HAPLN2, HAS3, HAVCR2, HDAC5, HDX, HECTD2-AS1, HEPH, HEY1, HMGA2, HMGN3-AS1, HNMT, HOOK3, HPS1, HSPA1L, HTATIP2, IFT57, IGDCC4, IGF2R, IGFBP3, IL16, INA, INPP5K, INTU, IQCG, ITGA11, ITGA8, ITGB8, ITIH1, ITPKA, IVD, KAT6B, KCNS1, KCNS2, KDM6A, KDSR, KIAA1456, KIAA1462, KIAA1755, KIT, KLF17, KLRG1, KMT2D, KRT7, KRTAP1-1, KRTAP1-5, L3MBTL2, LAMB2P1, LETM2, LGI2, LGR4, LHX9, LINC00472, LINC00570, LINC00578, LINC00607, LINC00678, LINC00702, LINC00886, LINC00961, LINC01011, LINC01118, LINC01204, LMOD1, LOC400927, LRBA, LRP4, LRRC32, LRRC39, LRRC42, LSAMP, LUM, LYPD1, LYRM1, MAFB, MAMDC2, MAN2A1, MAN2C1, MAPK13, MASP1, MB, MB21D2, MC4R, MCM10, MED13L, MEGF6, MFN2, MIAT, MIR612, MLLT10, MMP10, MMP24, MN1, MOXD1, MRPL45, MRPL55, MRPS28, MRVI1, MSH4, MTERF3, MXRA5, MYCBP2, NA, NAALADL2, NAE1, NAGS, NDNF, NGF, NGFR, NHLH1, NLN, NOTCH3, NOTUM, NOVA2, NOX4, NRROS, OCLN, OLR1, OSBPL10, OXCT1, OXCT2, PAIP2B, PBLD, PDE1C, PDE5A, PDGFD, PDGFRB, PDS5B, PEAR1, PHACTR3, PIGN, PIK3CD, PIK3R1, PIKFYVE, PIM2, PITPNM3, PLEK2, PLEKHA1, PLEKHA6, PLEKHH2, PLSCR1, PNISR, PODN, POLN, POLR1A, POMT2, PPARG, PPIP5K2, PPM1E, PPP1R26, PPP3CA, PRKCA, PRKG1, PRPF31, PRPH2, PRRG4, PRUNE2, PSMD6-AS2, PTGIS, PTX3, PXK, RAB30, RAB38, RAB44, RAD9B, RAF1, RAPGEF1, RARS, RARS2, RBBP8, RBKS, RDX, RERE, RFX3-AS1, RGCC, ROR1, ROR2, RPA1, RPS10, RPS6KB2, SAMD4A, SCARNA9, SEC24A, SENP6, SERGEF, SGK3, SH3YL1, SHROOM3, SIGLEC10, SKA2, SLC12A2, SLC24A3, SLC35F3, SLC39A10, SLC44A2, SLC46A2, SLC4A11, SLC6A15, SLC7A11, SLC9A3, SLIT3, SMG1P3, SMTN, SNED1, SNX7, SORBS2, SORCS2, SOX7, SPATA18, SPATA5, SPDYA, SPEF2, SPIDR, SPRYD7, SRGAP1, SRRM1, STAC2, STAT4, STK32B, STRN4, STS, STXBP6, SULF1, SVEP1, SYNGR2, SYNPO, SYNPO2, SYNPO2L, TAGLN3, TANGO6, TASP1, TCF12, TCF4, TGFA, TGFB2, TGFB3, TGM2, THBS2, TIAM1, TMC3, TMEM102, TMEM119, TMEM134, TMEM189-UBE2V1, TMEM214, TMEM256-PLSCR3, TMEM50B, TNFAIP8L3, TNFRSF14, TNRC18P1, TNRC6A, TNXB, TP53AIP1, TPRG1, TRIM66, TRPC4, TSHZ2, TSPAN11, TSPAN18, TSPAN7, TSSK3, TTC7B, TUBE1, TXNIP, TYW5, URGCP, USP27X, UVRAG, VAV2, VIM-AS1, VPS41, VSTM2L, VWF, WDR27, WDR91, WISP1, WNK1, WNT10B, YDJC, ZBTB26, ZCCHC5, ZCCHC8, ZFP82, ZMIZ1-AS1, ZNF138, ZNF212, ZNF232, ZNF350, ZNF431, ZNF660, ZNF680, ZNF79, or ZNF837. In some embodiments, the intron further comprises a first 5' splice site, a second branch point, and a second 3' splice site upstream of the iREMS.

In certain embodiments, the cell(s) contacted or cultured with a compound of Formula (I) or a form thereof is primary cell(s) or cell(s) from a cell line. In some embodiments, the cell(s) contacted or cultured with a compound of Formula (I) or a form thereof is a fibroblast(s), an immune cell(s), or a muscle cell(s). In some embodiments, the cell(s) contacted or cultured with a compound of Formula (I) or a form thereof is a cancer cell. Non-limiting examples of cell lines include 3T3, 4T1, 721, 9L, A2780, A172, A20, A253, A431, A-549, ALC, B16, B35, BCP-1, BEAS-2B, bEnd.3, BHK, BR 293, BT2O, BT483, BxPC3, C2C12, C3H-10T1/2, C6/36, C6, Cal-27, CHO, COR-L23, COS, COV-434, CIVIL T1, CMT, CRL7O3O, CT26, D17, DH82, DU145, DuCaP, EL4, EM2, EM3, EMT6, FM3, H1299, H69, HB54, HB55, HCA2, HDF, HEK-293, HeLa, Hepa1c1c7, HL-60, HMEC, Hs578T, HsS78Bst, HT-29, HTB2, HUVEC, Jurkat, J558L, JY, K562, Ku812, KCL22, KG1, KYO1, LNCap, Ma-Mel, MC-38, MCF-7, MCF-10A, MDA-MB-231, MDA-MB-468, MDA-MB-435, MDCK, MG63, MOR/ 0.2R, MONO-MAC 6, MRCS, MTD-1A, NCI-H69, NIH-3T3, NALM-1, NS0, NW-145, OPCN, OPCT, PNT-1A, PNT-2, Raji, RBL, RenCa, RIN-5F, RMA, Saos-2, Sf21, Sf9, SH-SY5Y, SiHa, SKBR3, SKOV-3, T2, T-47D, T84, THP1, U373, U87, U937, VCaP, Vero, VERY, W138, WM39, WT-49, X63, YAC-1, and YAR cells. In one embodiment, the cells are from a patient. In another embodiment, the patient cells are GM03813 cells.

In certain embodiments described herein, the cell(s) is contacted or cultured with a compound of Formula (I) or a form thereof with a compound of Formula (I) or a form thereof for a period of 15 minutes, 30 minutes, 45 minutes, 1 hour, 2 hours, 3 hours, 4 hours, 5 hours, 6 hours, 8 hours, 12 hours, 18 hours, 24 hours, 48 hours, 72 hours or more. In other embodiments described herein, the cell(s) is contacted or cultured with a compound of Formula (I) or a form thereof with a compound of Formula (I) or a form thereof for a period of 15 minutes to 1 hour, 1 to 2 hours, 2 to 4 hours, 6 to 12 hours, 12 to 18 hours, 12 to 24 hours, 28 to 24 hours, 24 to 48 hours, 48 to 72 hours.

In certain embodiments described herein, the cell(s) is contacted or cultured with a certain concentration of a compound of Formula (I) or a form thereof, wherein the certain concentration is 0.01 µM, 0.05 µM, 1 µM, 2 µM, 5 µM, 10 µM, 15 µM, 20 µM, 25 µM, 50 µM, 75 µM, 100 µM, or 150 µM. In other embodiments described herein, the cell(s) is contacted or cultured with a certain concentration of a compound of Formula (I) or a form thereof, wherein the certain concentration is 175 µM, 200 µM, 250 µM, 275 µM, 300 µM, 350 µM, 400 µM, 450 µM, 500 µM, 550 µM 600 µM, 650 µM, 700 µM, 750 µM, 800 µM, 850 µM, 900 µM, 950 µM or 1 mM. In some embodiments described herein, the cell(s) is contacted or cultured with a certain concentration of a compound of Formula (I) or a form thereof, wherein the certain concentration is 5 nM, 10 nM, 20 nM, 30 nM, 40 nM, 50 nM, 60 nM, 70 nM, 80 nM, 90 nM, 100 nM, 150 nM, 200 nM, 250 nM, 300 nM, 350 nM, 400 nM, 450 nM, 500 nM, 550 nM, 600 nM, 650 nM, 700 nM, 750 nM, 800 nM, 850 nM, 900 nM, or 950 nM. In certain embodiments described herein, the cell(s) is contacted or cultured with a certain concentration of a compound of Formula (I) or a form thereof, wherein the certain concentration is between 0.01 µM to 0.1 µM, 0.1 µM to 1 µM, 1 µM to 50 µM, 50 µM to 100 µM, 100 µM to 500 µM, 500 µM to 1 nM, 1 nM to 10 nM, 10 nM to 50 nM, 50 nM to 100 nM, 100 nM to 500 nM, 500 nM to 1000 nM. In certain embodiments described herein, the cell(s) is contacted or cultured with a certain concentration of a compound of Formula (I) or a form thereof that results in a substantial change in the amount of an RNA transcript (e.g., an mRNA transcript), an alternatively spliced variant, or an isoform of a gene (e.g., a gene in Table 1, infra).

In another aspect, provided herein are methods for modulating the amount of one, two, three or more RNA transcripts of a gene, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the precursor RNA transcript further contains a branch point and a 3' splice site upstream from the intronic REMS.

In one embodiment, provided herein are methods for modulating the amount of one, two, three or more RNA transcripts of a gene, by way of nonlimiting example, disclosed in Table 1, infra, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the RNA transcript contains in 5' to 3' order: a branch point, a 3' splice site and an intronic REMS.

In another embodiment, provided herein are methods for modulating the amount of one, two, three or more RNA transcripts of a gene, disclosed in Tables 2-7, infra, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for modulating the amount of one, two, three or more RNA transcripts of a gene in a subject, disclosed in International Patent Application No. PCT/US2014/071252 (International Publication No. WO 2015/105657), wherein the precursor RNA transcript transcribed from the gene comprises an intronic REMS, the methods comprising administering to the subject a compound of Formula (I) or a form thereof, or a pharmaceutical composition comprising a compound of Formula (I) or a form thereof and a pharmaceutically acceptable carrier, excipient or diluent. In another embodiment, provided herein are methods for modulating the amount of one, two, three or more RNA transcripts of a gene in a subject, disclosed in International Patent Application No. PCT/US2016/034864 (International Publication No. WO 2016/196386), wherein the precursor RNA transcript transcribed from the gene comprises an intronic REMS, the methods comprising administering to the subject a compound of Formula (I) or a form thereof, or a pharmaceutical composition comprising a compound of Formula (I) or a form thereof and a pharmaceutically acceptable carrier, excipient or diluent. In a specific embodiment, the precursor RNA transcript contains in 5' to 3' order: a branch point, a 3' splice site and an intronic REMS.

In another embodiment, provided herein are methods for modulating the amount of one, two, three or more RNA transcripts of a gene, disclosed in International Patent Application No. PCT/US2014/071252 (International Publication No. WO 2015/105657), wherein the precursor RNA transcript transcribed from the gene comprises an intronic REMS, the methods comprising administering a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for modulating the amount of one, two, three or more RNA transcripts of a gene, disclosed in International Patent Application No. PCT/US2016/034864 (International Publication No. WO 2016/196386), wherein the precursor RNA transcript transcribed from the gene comprises an intronic REMS, the methods comprising administering a human or non-human subject a compound of Formula (I) or a form thereof, or a pharmaceutical composition comprising a compound of Formula (I)

or a form thereof and a pharmaceutically acceptable carrier, excipient or diluent. In a specific embodiment, the precursor RNA transcript contains in 5' to 3' order: a branch point, a 3' splice site and an intronic REMS.

In a particular aspect, provided herein are methods for modulating the amount of one, two, three or more RNA transcripts of a gene in a subject, wherein the precursor RNA transcript transcribed from the gene comprises an intronic REMS (for example, an endogenous intronic REMS or a non-endogenous intronic REMS), the methods comprising administering to the subject a compound of Formula (I) or a form thereof, or a pharmaceutical composition comprising a compound of Formula (I) or a form thereof and a pharmaceutically acceptable carrier, excipient or diluent. In a specific embodiment, the precursor RNA transcript contains in 5' to 3' order a branch point, a 3' splice site and an intronic REMS. In specific embodiments of the foregoing aspects, as listed in Table 1, the gene is ABCA1, ABCA10, ABCB7, ABCB8, ABCC1, ABCC3, ABHD10, ABL2, ABLIM3, ACACA, ACADVL, ACAT2, ACTA2, ADAL, ADAM12, ADAM15, ADAM17, ADAM33, ADAMTS1, ADCY3, ADD1, ADGRG6, ADH6, ADHFE1, AFF2, AFF3, AGK, AGPAT3, AGPAT4, AGPS, AHCYL2, AHDC1, AHRR, AJUBA, AK021888, AK310472, AKAP1, AKAP3, AKAP9, AKNA, ALCAM, ALDH4A1, AMPD2, ANK1, ANK2, ANK3, ANKFY1, ANKHD1-EIF4EBP3, ANKRA2, ANKRD17, ANKRD33B, ANKRD36, ANKS6, ANP32A, ANXA11, ANXA6, AP2B1, AP4B1-AS1, APAF1, APIP, APLP2, APP, APPL2, APTX, ARHGAP1, ARHGAP12, ARHGAP22, ARHGEF16, ARID1A, ARID2, ARID5B, ARL9, ARL15, ARMCX3, ARMCX6, ASAP1, ASIC1, ASL, ASNS, ASPH, ATAD2B, ATF7IP, ATG5, ATG9A, ATMIN, ATP2A3, ATP2C1, ATXN1, ATXN3, AURKA, AXIN1, B3GALT2, B3GNT6, B4GALT2, BACE1, BAG2, BASP1, BC033281, BCAR3, BCL2L15, BCYRN1, BECN1, BEND6, BHMT2, BICD1, BIN1, BIN3-IT1, BIRC3, BIRC6, BNC1, BRD2, BRPF1, BSCL2, BTBD10, BTG2, BTN3A1, BZW1, C1orf86, C10orf54, C11orf30, C11orf70, C11orf73, C11orf94, C12orf4, C12orf56, C14orf132, C17orf76-AS1, C19orf47, C3, C4orf27, C5orf24, C6orf48, C7orf31, C8orf34, C8orf44, C8orf44-SGK3, C8orf88, C9orf69, CA13, CA3, CAB39, CACNA2D2, CACNB1, CADM1, CALU, CAMKK1, CAND2, CAPNS1, CASC3, CASP7, CASP8AP2, CAV1, CCAR1, CCDC77, CCDC79, CCDC88A, CCDC92, CCDC122, CCER2, CCNF, CCT6A, CD276, CD46, CDC25B, CDC40, CDC42BPA, CDCA7, CDH11, CDH13, CDK11B, CDK16, CDKAL1, CECR7, CELSR1, CEMIP, CENPI, CEP112, CEP170, CEP192, CEP68, CFH, CFLAR, CHD8, CHEK1, CIITA, CIZ1, CLDN23, CLIC1, CLK4, CLTA, CMAHP, CNGA4, CNOT1, CNRIP1, CNTD1, COG1, COL1A1, COL11A1, COL12A1, COL14A1, COL15A1, COL5A1, COL5A3, COL6A1, COL6A6, COL8A1, COLEC12, COMP, COPS7B, CPA4, CPEB2, CPQ, CPSF4, CREB5, CRISPLD2, CRLF1, CRLS1, CRTAP, CRYBG3, CRYL1, CSDE1, CSNK1A1, CSNK1E, CSNK1G1, CTDSP2, CTNND1, CUL2, CUL4A, CUX1, CYB5B, CYB5R2, CYBRD1, CYGB, CYP1B1, CYP51A1, DAB2, DACT1, DAGLB, DARS, DAXX, DCAF10, DCAF11, DCAF17, DCBLD2, DCLK1, DCN, DCUN1D4, DDAH1, DDAH2, DDHD2, DDIT4L, DDR1, DDX39B, DDX42, DDX50, DEGS1, DENND1A, DENND1B, DENND5A, DEPTOR, DFNB59, DGCR2, DGKA, DHCR24, DHCR7, DHFR, DHX9, DIAPH1, DIAPH3, DIRAS3, DIS3L, DKFZp434M1735, DKK3, DLC1, DLG5, DLGAP4, DNAH8, DNAJC13, DNAJC27, DNM2, DNMBP, DOCK1, DOCK11, DPP8, DSEL, DST, DSTN, DYNC1I1, DYRK1A, DZIP1L, EBF1, EEA1, EEF1A1, EFCAB14, EFEMP1, EGR1, EGR3, EHMT2, EIF2B3, EIF4G1, EIF4G2, EIF4G3, ELF2, ELN, ELP4, EMX2OS, ENAH, ENG, ENPP1, ENPP2, ENSA, EP300, EPN1, EPT1, ERC1, ERCC1, ERCC8, ERGIC3, ERLIN2, ERRFI1, ESM1, ETV5, EVC, EVC2, EXO1, EXTL2, EYA3, F2R, FADS1, FADS2, FAF1, FAIM, FAM111A, FAM126A, FAM13A, FAM160A1, FAM162A, FAM174A, FAM198B, FAM20A, FAM219A, FAM219B, FAM3C, FAM46B, FAM65A, FAM65B, FAP, FARP1, FBLN2, FBN2, FBXO9, FBXL6, FBXO10, FBXO18, FBXO31, FBXO34, FBXO9, FCHO1, FDFT1, FDPS, FER, FEZ1, FGD5-AS1, FGFR2, FGFRL1, FGL2, FHOD3, FLII, FLNB, FLT1, FN1, FNBP1, FOCAD, FOS, FOSB, FOSL1, FOXK1, FOXM1, FRAS1, FSCN2, FUS, FYN, GABPB1, GAL3ST4, GALC, GALNT1, GALNT15, GAS7, GATA6, GBA2, GBGT1, GCFC2, GCNT1, GDF6, GGACT, GGCT, GHDC, GIGYF2, GJC1, GLCE, GMIP, GNA13, GNAQ, GNAS, GNL3L, GOLGA2, GOLGA4, GOLGB1, GORASP1, GPR1, GPR183, GPR50, GPR89A, GPRC5A, GPRC5B, GPSM2, GREM1, GRK6, GRTP1, GSE1, GTF2H2B, GUCA1B, GULP1, GXYLT1, HAPLN1, HAPLN2, HAS2, HAS3, HAT1, HAUS3, HAUS6, HAVCR2, HDAC5, HDAC7, HDX, HECTD2-AS1, HEG1, HEPH, HEY1, HLA-A, HLA-E, HLTF, HMGA1, HMGA2, HMGB1, HMGCR, HMGN3-AS1, HMGCS1, HOOK3, HMOX1, HNMT, HNRNPR, HNRNPUL1, HP1BP3, HPS1, HRH1, HSD17B12, HSD17B4, HSPA1L, HTATIP2, HTT, IARS, IDH1, IDI1, IFT57, IGDCC4, IGF2BP2, IGF2R, IGFBP3, IL16, IL6ST, INA, INHBA, INPP5K, INSIG1, INTU, IQCE, IQCG, ITGA11, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIF14, KIF2A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LARP7, LATS2, LDLR, LEMD3, LETM2, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LMAN2L, LMO7, LMOD1, LOC400927, LONP1, LOX, LRBA, LRCH4, LRIG1, LRP4, LRP8, LRRC32, LRRC39, LRRC42, LRRC8A, LSAMP, LSS, LTBR, LUC7L2, LUM, LYPD1, LYRM1, LZTS2, MADD, MAFB, MAGED4, MAGED4B, MAMDC2, MAN1A2, MAN2A1, MAN2C1, MAP4K4, MAPK13, MASP1, MB, MB21D2, MBD1, MBOAT7, MC4R, MCM10, MDM2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MOXD1, MPPE1, MPZL1, MRPL3, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR9, MTRR, MUM1, MVD, MVK, MXRA5, MYADM, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NELFA, NEO1, NEURL1B, NF2, NFE2L1, NFX1, NGF, NGFR, NHLH1, NID1, NID2, NIPA1, NKX3-1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PBLD, PCBP2, PCBP4, PCDHGB3, PCGF3, PCM1, PCMTD2, PCNXL2, PCSK9, PDE1C, PDE4A, PDE5A, PDE7A, PDGFD, PDGFRB, PDLIM7, PDS5B, PDXDC1, PEAR1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPHLN1, PPIP5K1, PPIP5K2, PPM1E, PPP1R12A, PPP1R26, PPP3CA, PPP6R1, PPP6R2, PRKACB, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTGIS, PTK2B, PTPN14, PTX3, PUF60, PUS7, PVR, PXK, PXN, QKI, RAB23, RAB2B, RAB30, RAB34, RAB38, RAB44, RAD1, RAD9B, RAD23B, RAF1, RALB, RAP1A, RAP1GDS1, RAPGEF1, RARG, RARS, RARS2, RASSF8, RBBP8, RBCK1, RBFOX2, RBKS, RBM10, RCC1, RDX, RERE, RFTN1, RFWD2, RFX3-AS1, RGCC, RGS10, RGS3, RIF1, RNF14, RNF19A, RNF38, RNFT1, ROR1, ROR2, RPA1, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SGK3, SGOL2, SH3RF1, SH3YL1, SHROOM3, SIGLEC10, SKA2, SKIL, SLC12A2, SLC24A3, SLC25A17, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMN2, SMPD4, SMTN, SMYD3, SMYD5, SNAP23, SNED1, SNHG16, SNX7, SNX14, SOCS2, SON, SORBS2, SORCS2, SOS2, SOX7, SPATA18, SPATA20, SPATA5, SPATS2, SPDYA, SPEF2, SPG20, SPIDR, SPRED2, SPRYD7, SQLE, SQRDL, SQSTM1, SRCAP, SREBF1, SREK1, SRGAP1, SRRM1, SRSF3, STAC2, STARD4, STAT1, STAT3, STAT4, STAU1, STC2, STEAP2, STK32B, STRIP1, STRN3, STRN4, STS, STX16, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBL2, TCF12, TCF4, TCF7L2, TENC1, TENM2, TEP1, TET3, TEX21P, TFCP2, TGFA, TGFB2, TGFB3, TGFBI, TGFBR1, TGFBRAP1, TGM2, THADA, THAP4, THBS2, THRB, TIAM1, TIMP2, TJP2, TLE3, TLK1, TMC3, TMEM102, TMEM119, TMEM134, TMEM154, TMEM189-UBE2V1, TMEM214, TMEM256-PLSCR3, TMEM47, TMEM50B, TMEM63A, TNC, TNFAIP3, TNFAIP8L3, TNFRSF12A, TNFRSF14, TNIP1, TNKS1BP1, TNPO3, TNRC18P1, TNRC6A, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNRD1, TYW5, U2SURP, UBAP2L, UBE2G2, UBE2V1, UBQLN4, UCHL5, UHMK1, UHRF1BP1L, UNC5B, URGCP, USP19, USP7, USP27X, UVRAG, VANGL1, VARS2, VAV2, VCL, VIM-AS1, VIPAS39, VPS13A, VPS29, VPS41, VPS51, VSTM2L, VWA8, VWF, WDR19, WDR27, WDR37, WDR48, WDR91, WIPF1, WISP1, WNK1, WNT5B, WNT10B, WSB1, WWTR1, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMYM2, ZNF12, ZNF138, ZNF148, ZNF212, ZNF219, ZNF227, ZNF232, ZNF24, ZNF268, ZNF28, ZNF281, ZNF335, ZNF350, ZNF37A, ZNF37BP, ZNF395, ZNF431, ZNF583, ZNF621, ZNF652, ZNF655, ZNF660, ZNF674, ZNF680, ZNF74, ZNF764, ZNF778, ZNF780A, ZNF79, ZNF827, ZNF837, ZNF839 or ZNF91.

In a specific embodiment of the foregoing aspect, as listed in Table 2, the gene is: ABCA1, ABCB7, ABCC1, ABHD10, ABL2, ABLIM3, ACACA, ACADVL, ACAT2, ADAM12, ADAM15, ADAM17, ADAM33, AFF2, AGK, AGPAT3, AGPS, AHCYL2, AHDC1, AHRR, AJUBA, AK021888, AK310472, AKAP1, AKAP9, AKNA, ALCAM, ALDH4A1, AMPD2, ANK2, ANKFY1, ANKHD1-EIF4EBP3, ANKRD17, ANKS6, ANP32A, ANXA11, ANXA6, AP2B1, APAF1, APLP2, APP, APPL2, APTX, ARHGAP22, ARID1A, ARID2, ARMCX3, ASAP1, ASL, ASNS, ASPH, ATAD2B, ATF7IP, ATG9A, ATMIN, ATP2C1, ATXN3, AURKA, AXIN1, B4GALT2, BACE1, BAG2, BASP1, BC033281, BCAR3, BEND6, BICD1, BIN1, BNC1, BRD2, BRPF1, BSCL2, BTBD10, BZW1, C11orf30, C11orf73, C17orf76-AS1, C4orf27, C5orf24, C6orf48, C9orf69, CAB39, CALU, CAMKK1, CAPNS1, CASC3, CASP8AP2, CAV1, CCAR1, CCDC77, CCDC88A, CCDC92, CCT6A, CD276, CD46, CDC25B, CDC40, CDC42BPA, CDCA7, CDH11, CDH13, CDK11B, CDK16, CDKAL1, CEP68, CFLAR, CHD8, CIZ1, CLIC1, CLK4, CNOT1, COG1, COL12A1, COL1A1, COL6A1, COPS7B, CPEB2, CREB5, CRLS1, CRTAP, CSDE1, CSNK1A1, CTDSP2, CTNND1, CUL2, CUL4A, CUX1, CYB5B, CYBRD1, CYP51A1, DAB2, DACT1, DARS, DAXX, DCAF10, DCAF11, DCBLD2, DCUN1D4, DDAH1, DDAH2, DDHD2, DDR1, DDX39B, DDX42, DENND1A, DENND1B, DENND5A, DGCR2, DGKA, DHCR24, DHCR7, DHFR, DHX9, DIAPH1, DIAPH3, DIS3L, DKFZp434M1735, DKK3, DLC1, DNM2, DOCK1, DPP8, DSEL, DST, DSTN, EBF1, EEA1, EEF1A1, EFCAB14, EGR1, EHMT2, EIF2B3, EIF4G1, EIF4G2, EIF4G3, ELF2, ENG, ENPP2, ENSA, EPN1, EPT1, ERC1, ERGIC3, ETV5, EXO1, EXTL2, EYA3, FADS1, FADS2, FAF1, FAM111A, FAM198B, FAM219A, FAM219B, FAM3C, FAM65A, FBXO10, FBXO18, FBXO31, FBXO34, FBXO9, FDFT1, FDPS, FER, FEZ1, FGD5-AS1, FGFRL1, FHOD3, FLII, FLNB, FN1, FNBP1, FOCAD, FOS, FOSB, FOSL1, FOXK1, FOXM1, FUS, FYN, GABPB1, GALC, GALNT1, GAS7, GBA2, GCFC2, GGCT, GHDC, GIGYF2, GJC1, GMIP, GNA13, GNAS, GNL3L, GOLGA2, GOLGA4, GOLGB1, GORASP1, GPR1, GPR89A, GPSM2, GREM1, GRK6, GSE1, GTF2H2B, HAS2, HAT1, HAUS3, HAUS6, HDAC7, HEG1, HLA-A, HLA-E, HLTF, HMGA1, HMGB1, HMGCR, HMGCS1, HMOX1, HNRNPR, HNRNPUL1, HP1BP3, HRH1, HSD17B12, HSD17B4, HTT, IARS, IDH1, IDI1, IGF2BP2, IL6ST, INHBA, INSIG1, IQCE, ITGAV, ITGB5, ITM2C, ITSN1, KANSL3, KCNK2, KIAA1033, KIAA1143, KIAA1199, KIAA1522, KIAA1524, KIAA1549, KIAA1715, KIF14, KIF2A, KIF3A, KLC1, KLC2, KLF6, KLHL7, KRT18, KRT19, KRT34, KRTAP2-3, LAMA2, LAMB1, LARP4, LARP7, LATS2, LDLR, LEMD3, LGALS8, LIMS1, LINC00341, LINC00657, LMAN2L, LMO7, LONP1, LOX, LRCH4, LRIG1, LRP8, LRRC8A, LSS, LTBR, LUC7L2, LZTS2, MADD, MAGED4, MAGED4B, MAN1A2, MAP4K4, MBD1, MBOAT7, MDM2, MED1, MEDAG, MEF2D, MEIS2, MEMO1, MEPCE, MFGE8, MICAL2, MINPP1, MKL1, MKLN1, MKNK2, MLLT4, ML S T8, MMAB, MMS19, MMS22L, MPPE1, MPZL1, MRPL3, MSANTD3, MSC, MSH2, MSH6, MSL3, MSMO1, MSRB3, MTAP, MTERFD1, MTHFD1L, MTMR9, MTRR, MITM1, MVD, MVK, MYADM, MYLK, MYO1D, MYO9B, MYOF, NAA35, NADK, NASP, NAV1, NAV2, NCOA1, NCOA3, NCOA4, NCSTN, NELFA, NEO1, NEURL1B, NF2, NFE2L1, NFX1, NID1, NID2, NIPA1, NKX3-1, NOL10, NOMO3, NPEPPS, NRD1, NREP, NRG1, NSUN4, NT5C2, NT5E, NTNG1, NUDT4, NUP153, NUP35, NUP50, NUPL1, NUSAP1, ODF2, OS9, OSBPL6, OSMR, P4HA1, P4HB, PABPC1, PAK4, PAPD4, PARD3, PARN, PARP14, PARP4, PARVB, PCBP2, PCBP4, PCDHGB3, PCGF3, PCM1, PCMTD2, PCNXL2, PCSK9, PDE4A, PDE7A, PDLIM7, PDXDC1, PEPD, PEX5, PFKP, PHF19, PHF8, PHRF1, PHTF2, PI4K2A, PIEZO1, PIGU, PIK3C2B, PITPNA, PITPNB, PITPNM1, PLAU, PLEC, PLEKHB2, PLSCR3, PLXNB2, PLXNC1, PMS1, POLE3, POLR3D, POSTN, POU2F1, PPAPDC1A, PPARA, PPHLN1, PPIP5K1, PPP1R12A, PPP6R1, PPP6R2, PRKACB, PRKDC, PRMT1, PRNP, PRSS23, PSMA4, PSMC1, PSMD6, PTK2B, PTPN14, PUF60, PUS7, PVR, PXN, QKI, RAB23, RAB2B, RAB34, RAD1, RAD23B, RALB, RAP1A, RAP1GDS1, RARG, RASSF8, RBCK1, RBFOX2, RBM10, RCC1, RFTN1, RFWD2, RGS10, RGS3, RIF1, RNF14, RNF19A, RNF38, RNFT1, RPL10, RPS6KC1, RRBP1, RWDD4, SAMD9, SAMD9L, SAR1A, SART3, SCAF4, SCAF8, SCD, SCLT1, SCO1, SDCBP, SEC14L1, SEC22A, SEC24B, SEC61A1, SEPT9, SERPINE2, SF1, SGOL2, SH3RF1, SKIL, SLC25A17, SLC39A3, SLC41A1, SLC4A4, SLC7A6, SLC7A8, SMARCA4, SMARCC2, SMC4, SMC6, SMCHD1, SMG1, SMN2, SMPD4, SMYD3, SMYD5, SNAP23, SNHG16, SNX14, SOCS2, SON, SOS2, SPATA20, SPATS2, SPG20, SPRED2, SQLE, SQRDL, SQSTM1, SRCAP, SREBF1, SREK1, SRSF3, STARD4, STAT1, STAT3, STAU1, STC2, STEAP2, STRIP1, STRN3, STX16, SUPT20H, SYNE1, SYNE2, SYT15, SYTL2, TACC1, TAF2, TANC2, TARBP1, TARS, TBC1D15, TBL2, TCF7L2, TENC1, TENM2, TEP1, TET3, TFCP2, TGFBI, TGFBR1, TGFBRAP1, THADA, THAP4, THRB, TIMP2, TJP2, TLE3, TLK1, TMEM154, TMEM47, TMEM63A, TNC, TNFAIP3, TNFRSF12A, TNIP1, TNKS1BP1, TNPO3, TNS1, TNS3, TOE1, TOMM40, TOMM5, TOPORS, TP53INP1, TRAF3, TRAK1, TRAPPC12, TRIB1, TRIM2, TRIM23, TRIM26, TRIM28, TRIM65, TRMT1L, TRPS1, TSC2, TSHZ1, TSPAN2, TTC7A, TUBB2C, TUBB3, TXNL1, TXNRD1, U2SURP, UBAP2L, UBE2G2, UBE2V1, UBQLN4, UCHL5, UHMK1, UHRF1BP1L, UNC5B, USP19, USP7, VANGL1, VARS2, VCL, VIPAS39, VPS13A, VPS29, VPS51, VWA8, WDR19, WDR37, WDR48, WIPF1, WNT5B, WSB1, WWTR1, XIAP, XRN2, YAP1, YES1, YPEL5, YTHDF3, Z24749, ZAK, ZBTB10, ZBTB24, ZBTB7A, ZC3H12C, ZC3H14, ZC3H18, ZCCHC11, ZEB1, ZEB2, ZFAND1, ZFAND5, ZHX3, ZMIZ1, ZMYM2, ZNF12, ZNF148, ZNF219, ZNF227, ZNF24, ZNF268, ZNF28, ZNF281, ZNF335, ZNF37A, ZNF37BP, ZNF395, ZNF583, ZNF621, ZNF652, ZNF655, ZNF674, ZNF74, ZNF764, ZNF778, ZNF780A, ZNF827, ZNF839 or ZNF91.

In a specific embodiment of the foregoing aspect, the gene is: ABCB8, ANKRD36, APLP2, ARHGAP12, ARMCX6, ASAP1, ATG5, AXIN1, BIRC6, C1orf86, CDC42BPA, CLTA, DYRK1A, ERGIC3, FBXL6, FOXM1, GGCT, KAT6B, KDM6A, KIF3A, KMT2D, LARP7, LYRM1, MADD, MAN2C1, MRPL55, MYCBP2, MYO9B, PNISR, RAP1A, RAPGEF1, SENP6, SH3YL1, SLC25A17, SMN2, SREK1, STRN3, TAF2, TMEM134, VPS29, ZFAND1 or ZNF431.

In another specific embodiment of the foregoing aspect, the gene is: ABCB8, ANKRD36, ARHGAP12, ARMCX6, ATG5, BIRC6, C1orf6, CLTA, DYRK1A, FBXL6, KAT6B, KDM6A, KMT2D, LYRM1, MAN2C1, MRPL55, MYCBP2, PNISR, RAPGEF1, SENP6, SH3YL1, TMEM134 or ZNF431.

In another specific embodiment of the foregoing aspect, the gene is: ABCA10, ABCC1, ACTA2, ADAL, ADAM12, ADAMTS1, ADAMTS5, ADD1, ADGRG6, ADH6, ADHFE1, AFF2, AFF3, AGK, AGPS, AKAP3, ANK1, ANK2, ANK3, ANKRD33B, ANXA11, ANXA6, AP4B1-AS1, ARHGEF16, ARID5B, ARL9, ARMCX3, ASAP1, ASIC1, ATP2A3, B3GALT2, B3GNT6, BCL2L15, BCYRN1, BIN3-IT1, BIRC3, BTG2, C10orf54, C11orf70, C11orf73, C11orf94, C12orf56, C19orf47, C3, C4orf27, C7orf31, C8orf34, CA13, CA3, CACNA2D2, CACNB1, CADM1, CAND2, CCDC79, CCER2, CCNF, CDCA7, CDKAL1, CELSR1, CEMIP, CEP170, CFH, CIITA, CLDN23, CMAHP, CNGA4, CNTD1, COL11A1, COL12A1, COL14A1, COL15A1, COL5A1, COL5A3, COL6A6, COL8A1, COLEC12, COMP, CPA4, CPQ, CRISPLD2, CRLF1, CRYL1, CUX1, CYB5B, CYB5R2, CYGB, CYP1B1, DCLK1, DCN, DDIT4L, DDX42, DDX50, DEGS1, DENND1A, DENND5A, DEPTOR, DFNB59, DGKA, DHFR, DIAPH3, DIRAS3, DIS3L, DLG5, DNAH8, DNAJC27, DOCK1, DOCK11, DYNC1I1, DZIP1L, EBF1, EFEMP1, EGR3, EIF2B3, ELN, ELP4, EMX2OS, ENPP1, ERCC8, ESM1, EVC2, F2R, FAM160A1, FAM198B, FAM20A, FAM46B, FAM65B, FAP, FARP1, FBLN2, FBN2, FBXO9, FCHO1, FER, FGFR2, FGL2, FLT1, FRAS1, FSCN2, GAL3ST4, GALC, GALNT15, GATA6, GBGT1, GCNT1, GDF6, GNAQ, GOLGB1, GPR183, GPR50, GPRC5A, GPRC5B, GRTP1, GUCA1B, GXYLT1, HAPLN1, HAPLN2, HAS3, HAVCR2, HDAC5, HECTD2-AS1, HEPH, HEY1, HLTF, HMGN3-AS1, HMOX1, HOOK3, HSD17B12, HSPA1L, HTATIP2, HTT, IGDCC4, IGF2R, IGFBP3, IL16, INA, INTU, IQCG, ITGA11, ITGA8, ITGB8, ITIH1, ITPKA, KCNS1, KCNS2, KDM6A, KDSR, KIAA1456, KIAA1462, KIAA1524, KIAA1715, KIAA1755, KIT, KLF17, KLRG1, KRT7, KRTAP1-1, KRTAP1-5, L3MBTL2, LAMB2P1, LGI2, LGR4, LHX9, LINC00472, LINC00570, LINC00578, LINC00607, LINC00678, LINC00702, LINC00886, LINC00961, LINC01011, LINC01118, LINC01204, LMOD1, LRBA, LRP4, LRRC32, LRRC39, LSAMP, LUM, LYPD1, LYRM1, MAFB, MAMDC2, MAN1A2, MAN2A1, MAPK13, MASP1, MB, MC4R, MEDAG, MEGF6, MEMO1, MIAT, MIR612, MLLT10, MMP10, MMP24, MMS19, MN1, MOXD1, MRVI1, MSH4, MTERF3, MXRA5, MYO1D, NA, NAALADL2, NAE1, NAGS, NDNF, NEURL1B, NGFR, NHLH1, NLN, NOTCH3, NOTUM, NOVA2, NOX4, NRROS, NTNG1, OCLN, OLR1, OSBPL10, OXCT2, PAIP2B, PAPD4, PBLD, PCM1, PDE1C, PDE5A, PDGFD, PDGFRB, PDS5B, PDXDC1, PEAR1, PEPD, PHACTR3, PI4K2B, PIK3R1, PIM2, PITPNB, PITPNM3, PLAU, PLEK2, PLEKHA6, PLEKHH2, PLXNC1, PMS1, PODN, POLN, POLR1A, POSTN, PPM1E, PPP3CA, PRKCA, PRKDC, PRKG1, PRPH2, PRRG4, PRUNE2, PSMD6-AS2, PTGIS, PTX3, RAB30, RAB38, RAB44, RAD9B, RARS, RBBP8, RBKS, RCC1, RDX, RFWD2, RFX3-AS1, RGCC, RNFT1, ROR1, ROR2, RWDD4, SCARNA9, SCO1, SEC22A, SHROOM3, SIGLEC10, SLC24A3, SLC35F3, SLC39A10, SLC46A2, SLC4A11, SLC6A15, SLC7A11, SLC9A3, SLIT3, SMG1P3, SMTN, SMYD3, SNED1, SORBS2, SORCS2, SOX7, SPDYA, SPEF2, SQRDL, STAC2, STAT1, STAT4, STEAP2, STK32B, STRN4, STS, STXBP6, SULF1, SVEP1, SYNGR2, SYNPO, SYNPO2, SYNPO2L, TAGLN3, TANGO6, TARBP1, TEX21P, TGFA, TGFB2, TGFB3, TGM2, THADA, THBS2, THRB, TMEM102, TMEM119, TMEM256-PLSCR3, TMEM50B, TNC, TNFAIP8L3, TNFRSF14, TNRC18P1, TNS3, TNXB, TP53AIP1, TPRG1, TRAF3, TRIM66, TRPC4, TSHZ2, TSPAN11, TSPAN18, TSPAN7, TSSK3, TXNIP, UNC5B, USP27X, UVRAG, VIM-AS1, VPS41, VSTM2L, VWA8, VWF, WDR91, WISP1, WNT10B, XRN2, YDJC, ZBTB26, ZCCHC5, ZFP82, ZMIZ1-AS1, ZNF212, ZNF350, ZNF660, ZNF79 or ZNF837.

In another specific embodiment of the foregoing aspect, the gene is: ABCA10, ACTA2, ADAL, ADAMTS1, ADAMTS5, ADD1, ADGRG6, ADH6, ADHFE1, AFF3, AKAP3, ANK1, ANK3, ANKRD33B, AP4B1-AS1, ARHGEF16, ARID5B, ARL9, ASIC1, ATP2A3, B3GALT2, B3GNT6, BCL2L15, BCYRN1, BIN3-IT1, BIRC3, BTG2, C10orf54, C11orf70, C11orf94, C12orf56, C19orf47, C3, C7orf31, C8orf34, CA13, CA3, CACNA2D2, CACNB1, CADM1, CAND2, CCDC79, CCER2, CCNF, CELSR1, CEMIP, CEP170, CFH, CIITA, CLDN23, CMAHP, CNGA4, CNTD1, COL11A1, COL14A1, COL15A1, COL5A1, COL5A3, COL6A6, COL8A1, COLEC12, COMP, CPA4, CPQ, CRISPLD2, CRLF1, CRYL1, CYB5R2, CYGB, CYP1B1, DCLK1, DCN, DDIT4L, DDX50, DEGS1, DEPTOR, DFNB59, DIRAS3, DLG5, DNAH8, DNAJC27, DOCK11, DYNC1I1, DZIP1L, EFEMP1, EGR3, ELN, ELP4, EMX2OS, ENPP1, ERCC8, ESM1, EVC2, F2R, FAM160A1, FAM20A, FAM46B, FAM65B, FAP, FARP1, FBLN2, FBN2, FBXO9, FCHO1, FGFR2, FGL2, FLT1, FRAS1, FSCN2, GAL3ST4, GALNT15, GATA6, GBGT1, GCNT1, GDF6, GNAQ, GPR183, GPR50, GPRC5A, GPRC5B, GRTP1, GUCA1B, GXYLT1, HAPLN1, HAPLN2, HAS3, HAVCR2, HDAC5, HECTD2-AS1, HEPH, HEY1, HMGN3-AS1, HOOK3, HSPA1L, HTATIP2, IGDCC4, IGF2R, IGFBP3, IL16, INA, INTU, IQCG, ITGA11, ITGA8, ITGB8, ITIH1, ITPKA, KCNS1, KCNS2, KDM6A, KDSR, KIAA1456, KIAA1462, KIAA1755, KIT, KLF17, KLRG1, KRT7, KRTAP1-1, KRTAP1-5, L3MBTL2, LAMB2P1, LGI2, LGR4, LHX9, LINC00472, LINC00570, LINC00578, LINC00607, LINC00678, LINC00702, LINC00886, LINC00961, LINC01011, LINC01118, LINC01204, LMOD1, LRBA, LRP4, LRRC32, LRRC39, LSAMP, LUM, LYPD1, MAFB, MAMDC2, MAN2A1, MAPK13, MASP1, MB, MC4R, MEGF6, MIAT, MIR612, MLLT10, MMP10, MMP24, MN1, MOXD1, MRVI1, MSH4, MTERF3, MXRA5, NA, NAALADL2, NAE1, NAGS, NDNF, NGFR, NHLH1, NLN, NOTCH3, NOTUM, NOVA2, NOX4, NRROS, OCLN, OLR1, OSBPL10, OXCT2, PAIP2B, PBLD, PDE1C, PDE5A, PDGFD, PDGFRB, PDS5B, PEAR1, PHACTR3, PI4K2B, PIK3R1, PIM2, PITPNM3, PLEK2, PLEKHA6, PLEKHH2, PODN, POLN, POLR1A, PPM1E, PPP3CA, PRKCA, PRKG1, PRPH2, PRRG4, PRUNE2, PSMD6-AS2, PTGIS, PTX3, RAB30, RAB38, RAB44, RAD9B, RARS, RBBP8, RBKS, RDX, RFX3-AS1, RGCC, ROR1, ROR2, SCARNA9, SHROOM3, SIGLEC10, SLC24A3, SLC35F3, SLC39A10, SLC46A2, SLC4A11, SLC6A15, SLC7A11, SLC9A3, SLIT3, SMG1P3, SMTN, SNED1, SORBS2, SORCS2, SOX7, SPDYA, SPEF2, STAC2, STAT4, STK32B, STRN4, STS, STXBP6, SULF1, SVEP1, SYNGR2, SYNPO, SYNPO2, SYNPO2L, TAGLN3, TANGO6, TEX21P, TGFA, TGFB2, TGFB3, TGM2, THBS2, TMEM102, TMEM119, TMEM256-PLSCR3, TMEM50B, TNFAIP8L3, TNFRSF14, TNRC18P1, TNXB, TP53AIP1, TPRG1, TRIM66, TRPC4, TSHZ2, TSPAN11, TSPAN18, TSPAN7, TSSK3, TXNIP, USP27X, UVRAG, VIM-AS1, VPS41, VSTM2L, VWF, WDR91, WISP1, WNT10B, YDJC, ZBTB26, ZCCHC5, ZFP82, ZMIZ1-AS1, ZNF212, ZNF350, ZNF660, ZNF79 or ZNF837.

In another specific embodiment of the foregoing aspect, as listed in Table 7, the gene is ABCB8, ABCC3, ADAM17, ADCY3, AGPAT4, ANKRA2, ANXA11, APIP, APLP2, APLP2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DAGLB, DCAF17, DCUN1D4, DDX42, DENND1A, DENND5A, DGKA, DHFR, DIAPH3, DLGAP4, DNAJC13, DNMBP, DOCK1, DYRK1A, EIF2B3, ENAH, ENOX1, EP300, ERC1, ERCC1, ERGIC3, ERLIN2, ERRFI1, EVC, FAF1, FAIM, FAM126A, FAM13A, FAM162A, FAM174A, FAM198B, FBN2, FER, FHOD3, FOCAD, GALC, GCFC2, GGACT, GGCT, GLCE, GOLGA4, GOLGB1, GPSM2, GULP1, GXYLT1, HAT1, HDX, HLTF, HMGA2, HNMT, HPS1, HSD17B12, HSD17B4, HTT, IFT57, INPP5K, IVD, KDM6A, KIAA1524, KIAA1715, LETM2, LOC400927, LRRC42, LUC7L3, LYRM1, MADD, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPHLN1, PPIP5K2, PPP1R26, PRPF31, PRSS23, PRUNE2, PSMA4, PXK, RAF1, RAP1A, RAPGEF1, RARS2, RBKS, RERE, RFWD2, RNFT1, RPA1, RPS10, RPS6KB2, SAMD4A, SAR1A, SCO1, SEC24A, SENP6, SERGEF, SGK3, SH3YL1, SKA2, SLC12A2, SLC25A17, SLC44A2, SMYD3, SNAP23, SNHG16, SNX7, SOS2, SPATA18, SPATA5, SPIDR, SPRYD7, SRGAP1, SRRM1, STAT1, STRN3, STXBP6, SUPT20H, TAF2, TASP1, TBC1D15, TCF12, TCF4, TIAM1, TJP2, TMC3, TMEM189-UBE2V1, TMEM214, TNRC6A, TNS3, TOE1, TRAF3, TRIM65, TSPAN2, TTC7B, TUBE1, TYW5, UBAP2L, UBE2V1, URGCP, VAV2, VPS29, WDR27, WDR37, WDR91, WNK1, XRN2, ZCCHC8, ZFP82, ZNF138, ZNF232, ZNF37BP or ZNF680.

In another specific embodiment of the foregoing aspect, the gene is ABCB8, ABCC3, ADAM17, ADCY3, AGPAT4, ANKRA2, ANXA11, APIP, APPL2, ARHGAP1, ARL15, ASAP1, ASPH, ATAD2B, ATXN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, CNRIP1, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, ENOX1, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPA1, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 or ZNF37BP.

In another specific embodiment of the foregoing aspect, the gene is APLP2, AXIN1, CECR7, DAGLB, DLGAP4, ERCC1, ERGIC3, FAM198B, GGCT, HAT1, HPS1, INPP5K, MADD, PPHLN1, PRUNE2, RAP1A, RNFT1, RPS6KB2, SH3YL1, SKA2, SPATA18, STRN3, TMEM189-UBE2V1, TRIM65, TUBE1, UBE2V1, VPS29 or ZNF680.

In another specific embodiment of the foregoing aspect, the gene is ABCB8, ABCC3, ADCY3, AGPAT4, ANKRA2, APIP, ARHGAP1, ARL15, ATXN1, BECN1, BHMT2, BTN3A1, C12orf4, C14orf132, C8orf44, C8orf44-SGK3, C8orf88, CASP7, CCDC122, CECR7, CENPI, CEP112, CEP192, CHEK1, CMAHP, CNRIP1, CPSF4, CRISPLD2, CRYBG3, CSNK1E, CSNK1G1, DAGLB, DCAF17, DLGAP4, DNAJC13, DNMBP, DYRK1A, ENAH, EP300, ERCC1, ERLIN2, ERRFI1, EVC, FAIM, FAM126A, FAM13A, FAM162A, FAM174A, FBN2, GGACT, GLCE, GULP1, GXYLT1, HDX, HMGA2, HNMT, HPS1, IFT57, INPP5K, IVD, KDM6A, LETM2, LOC400927, LRRC42, LYRM1, MB21D2, MCM10, MED13L, MFN2, MRPL45, MRPS28, MTERF3, MYCBP2, NGF, OXCT1, PDS5B, PIGN, PIK3CD, PIK3R1, PIKFYVE, PLEKHA1, PLSCR1, POMT2, PPARG, PPIP5K2, PPP1R26, PRPF31, PRUNE2, PXK, RAF1, RAPGEF1, RARS2, RBKS, RERE, RPA1, RPS10, RPS6KB2, SAMD4A, SEC24A, SENP6, SERGEF, SGK3, SH3YL1, SKA2, SLC12A2, SLC44A2, SNX7, SPATA18, SPATA5, SPIDR, SPRYD7, SRGAP1, SRRM1, STXBP6, TASP1, TCF12, TCF4, TIAM1, TMC3, TMEM189-UBE2V1, TMEM214, TNRC6A, TTC7B, TUBE1, TYW5, URGCP, VAV2, WDR27, WDR91, WNK1, ZCCHC8, ZFP82, ZNF138, ZNF232 or ZNF680.

In another particular aspect, provided herein are methods for modulating the amount of one, two, three or more RNA transcripts of a gene in a subject, wherein the precursor RNA transcript transcribed from the gene comprises an intronic REMS (for example, an endogenous intronic REMS or a non-endogenous intronic REMS), the methods comprising administering to the subject a compound of Formula (I) or a form thereof, or a pharmaceutical composition comprising a compound of Formula (I) or a form thereof and a pharmaceutically acceptable carrier, excipient or diluent. In a specific embodiment, the precursor RNA transcript contains in 5' to 3' order: a branch point, a 3' splice site and an intronic REMS.

In another particular aspect, provided herein are methods for modulating the amount of one, two, three or more RNA transcripts of a gene in a subject, wherein the precursor RNA transcript transcribed from the gene comprises a non-endogenous intronic REMS, the methods comprising administering to the subject a compound of Formula (I) or a form thereof, or a pharmaceutical composition comprising a compound of Formula (I) or a form thereof and a pharmaceutically acceptable carrier, excipient or diluent. In a specific embodiment, the precursor RNA transcript contains in 5' to 3' order: a branch point, a 3' splice site and an intronic REMS.

In another embodiment, provided herein are methods for modulating the amount of one, two, three or more RNA transcripts of a gene, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the precursor RNA transcript contains in 5' to 3' order: a branch point, a 3' splice site and an intronic REMS.

In another embodiment, provided herein is a method for modulating the amount of a product of a gene (such as an RNA transcript or a protein) in a subject, wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, an iREMS, a nucleotide sequence encoding a second branch point and a nucleotide sequence encoding a second 3' splice site, wherein the iREMS comprises a DNA sequence GAgtrngn (SEQ ID NO: 4), and wherein r is adenine or guanine and n is any nucleotide, the method comprising administering a compound described herein (for example, a compound of Formula (I) or a form thereof) to the subject.

In another embodiment, provided herein is a method for modulating the amount of a product of a gene (such as an RNA transcript or protein) in a subject, wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence of the intron comprises in 5' to 3' order: an iREMS, a nucleotide sequence encoding a first branch point and a nucleotide sequence encoding a first 3' splice site, wherein the iREMS comprises a DNA sequence GAgtrngn (SEQ ID NO: 4), and wherein r is adenine or guanine and n is any nucleotide, the method comprising administering a compound described herein (for example, a compound of Formula (I) or a form thereof) to the subject.

In another embodiment, provided herein is a method for modulating the amount of a product of a gene (such as an RNA transcript or protein) in a subject, wherein the gene comprises a DNA nucleotide sequence encoding two exons and an intron, and wherein the DNA nucleotide sequence comprises exonic and intronic elements illustrated in FIG. 1A, the method comprising administering a compound described herein (for example, a compound of Formula (I) or a form thereof) to the subject.

In another embodiment, provided herein is a method for modulating the amount of a product of a gene (such as an RNA transcript or protein) in a subject, wherein the gene comprises a DNA nucleotide sequence encoding two exons and an intron, and wherein the DNA nucleotide sequence comprises exonic and intronic elements illustrated in FIG. 1B, the method comprising administering a compound described herein (for example, a compound of Formula (I) or a form thereof) to the subject.

In another embodiment, provided herein is a method for modulating the amount of a product of a gene (such as an RNA transcript or protein) in a subject, wherein the gene comprises a DNA nucleotide sequence encoding two exons and an intron, and wherein the DNA nucleotide sequence comprises exonic and intronic elements illustrated in FIG. 1C, the method comprising administering a compound described herein (for example, a compound of Formula (I) or a form thereof) to the subject.

In a specific embodiment, the gene is a gene described in a table in this disclosure.

In another embodiment, provided herein are methods for modulating the amount of one, two, three or more RNA transcripts of a gene, disclosed in Table 7, infra, comprising administering to a human or non-human subject a compound of Formula (I) or a form thereof, or a pharmaceutical composition comprising a compound of Formula (I) or a form thereof and a pharmaceutically acceptable carrier, excipient or diluent. See the example section for additional information regarding the genes in Table 7. In a specific embodiment, the RNA transcript contains in 5' to 3' order: a branch point, a 3' splice site and an intronic REMS. In a specific embodiment, the method for modulating the amount of one or more RNA transcripts of a gene using a compound of Formula (I) or a form thereof is as described in the Examples described herein.

In certain embodiments, a compound of Formula (I) or a form thereof contacted or cultured with a cell(s), or administered to a subject is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV). In some embodiments, a compound of Formula (I) or a form thereof contacted or cultured with a cell(s), or administered to a subject is a compound described herein.

Table 1 shows certain genes that are expected to demonstrate an effect on inclusion of an iExon with a corresponding change in isoform abundance as a result of iExon generation in RNA having intronic REMS elements in the presence of a compound as described herein. The change in abundance is expected to have a statistically significant p value.

TABLE 1

ABCA1, ABCA10, ABCB7, ABCB8, ABCC1, ABCC3, ABHD10, ABL2, ABLIM3,
ACACA, ACADVL, ACAT2, ACTA2, ADAL, ADAM12, ADAM15, ADAM17, ADAM33,
ADAMTS1, ADCY3, ADD1, ADGRG6, ADH6, ADHFE1, AFF2, AFF3, AGK, AGPAT3,
AGPAT4, AGPS, AHCYL2, AHDC1, AHRR, AJUBA, AK021888, AK310472, AKAP1,
AKAP3, AKAP9, AKNA, ALCAM, ALDH4A1, AMPD2, ANK1, ANK2, ANK3, ANKFY1,
ANKHD1-EIF4EBP3, ANKRA2, ANKRD17, ANKRD33B, ANKRD36, ANKS6, ANP32A,
ANXA11, ANXA6, AP2B1, AP4B1-AS1, APAF1, APIP, APLP2, APP, APPL2, APTX,
ARHGAP1, ARHGAP12, ARHGAP22, ARHGEF16, ARID1A, ARID2, ARID5B, ARL9,
ARL15, ARMCX3, ARMCX6, ASAP1, ASIC1, ASL, ASNS, ASPH, ATAD2B, ATF7IP,
ATG5, ATG9A, ATMIN, ATP2A3, ATP2C1, ATXN1, ATXN3, AURKA, AXIN1,
B3GALT2, B3GNT6, B4GALT2, BACE1, BAG2, BASP1, BC033281, BCAR3, BCL2L15,
BCYRN1, BECN1, BEND6, BHMT2, BICD1, BIN1, BIN3-IT1, BIRC3, BIRC6, BNC1,
BRD2, BRPF1, BSCL2, BTBD10, BTG2, BTN3A1, BZW1, C1orf86, C10orf54, C11orf30,
C11orf70, C11orf73, C11orf94, C12orf4, C12orf56, C14orf132, C17orf76-AS1, C19orf47,
C3, C4orf27, C5orf24, C6orf48, C7orf31, C8orf34, C8orf44, C8orf44-SGK3, C8orf88,
C9orf69, CA13, CA3, CAB39, CACNA2D2, CACNB1, CADM1, CALU, CAMKK1,
CAND2, CAPNS1, CASC3, CASP7, CASP8AP2, CAV1, CCAR1, CCDC77, CCDC79,
CCDC88A, CCDC92, CCDC122, CCER2, CCNF, CCT6A, CD276, CD46, CDC25B,
CDC40, CDC42BPA, CDCA7, CDH11, CDH13, CDK11B, CDK16, CDKAL1, CECR7,
CELSR1, CEMIP, CENPI, CEP112, CEP170, CEP192, CEP68, CFH, CFLAR, CHD8,
CHEK1, CIITA, CIZ1, CLDN23, CLIC1, CLK4, CLTA, CMAHP, CNGA4, CNOT1,
CNRIP1, CNTD1, COG1, COL1A1, COL11A1, COL12A1, COL14A1, COL15A1, COL5A1,
COL5A3, COL6A1, COL6A6, COL8A1, COLEC12, COMP, COPS7B, CPA4, CPEB2, CPQ,
CPSF4, CREB5, CRISPLD2, CRLF1, CRLS1, CRTAP, CRYBG3, CRYL1, CSDE1,
CSNK1A1, CSNK1E, CSNK1G1, CTDSP2, CTNND1, CUL2, CUL4A, CUX1, CYB5B,
CYB5R2, CYBRD1, CYGB, CYP1B1, CYP51A1, DAB2, DACT1, DAGLB, DARS, DAXX,
DCAF10, DCAF11, DCAF17, DCBLD2, DCLK1, DCN, DCUN1D4, DDAH1, DDAH2,
DDHD2, DDIT4L, DDR1, DDX39B, DDX42, DDX50, DEGS1, DENND1A, DENND1B,
DENND5A, DEPTOR, DFNB59, DGCR2, DGKA, DHCR24, DHCR7, DHFR, DHX9,
DIAPH1, DIAPH3, DIRAS3, DIS3L, DKFZp434M1735, DKK3, DLC1, DLG5, DLGAP4,
DNAH8, DNAJC13, DNAJC27, DNM2, DNMBP, DOCK1, DOCK11, DPP8, DSEL, DST,
DSTN, DYNC1I1, DYRK1A, DZIP1L, EBF1, EEA1, EEF1A1, EFCAB14, EFEMP1, EGR1,
EGR3, EHMT2, EIF2B3, EIF4G1, EIF4G2, EIF4G3, ELF2, ELN, ELP4, EMX2OS, ENAH,
ENG, ENPP1, ENPP2, ENSA, EP300, EPN1, EPT1, ERC1, ERCC1, ERCC8, ERGIC3,
ERLIN2, ERRFI1, ESM1, ETV5, EVC, EVC2, EXO1, EXTL2, EYA3, F2R, FADS1, FADS2,
FAF1, FAIM, FAM111A, FAM126A, FAM13A, FAM160A1, FAM162A, FAM174A,
FAM198B, FAM20A, FAM219A, FAM219B, FAM3C, FAM46B, FAM65A, FAM65B, FAP,
FARP1, FBLN2, FBN2, FBXO9, FBXL6, FBXO10, FBXO18, FBXO31, FBXO34, FBXO9,
FCHO1, FDFT1, FDPS, FER, FEZ1, FGD5-AS1, FGFR2, FGFRL1, FGL2, FHOD3, FLII,
FLNB, FLT1, FN1, FNBP1, FOCAD, FOS, FOSB, FOSL1, FOXK1, FOXM1, FRAS1,
FSCN2, FUS, FYN, GABPB1, GAL3ST4, GALC, GALNT1, GALNT15, GAS7, GATA6,
GBA2, GBGT1, GCFC2, GCNT1, GDF6, GGACT, GGCT, GHDC, GIGYF2, GJC1, GLCE,
GMIP, GNA13, GNAQ, GNAS, GNL3L, GOLGA2, GOLGA4, GOLGB1, GORASP1, GPR1,
GPR183, GPR50, GPR89A, GPRC5A, GPRC5B, GPSM2, GREM1, GRK6, GRTP1, GSE1,
GTF2H2B, GUCA1B, GULP1, GXYLT1, HAPLN1, HAPLN2, HAS2, HAS3, HAT1,
HAUS3, HAUS6, HAVCR2, HDAC5, HDAC7, HDX, HECTD2-AS1, HEG1, HEPH, HEY1,
HLA-A, HLA-E, HLTF, HMGA1, HMGA2, HMGB1, HMGCR, HMGN3-AS1, HMGCS1,
HOOK3, HMOX1, HNMT, HNRNPR, HNRNPUL1, HP1BP3, HPS1, HRH1, HSD17B12,

TABLE 1-continued

HSD17B4, HSPA1L, HTATIP2, HTT, IARS, IDH1, IDI1, IFT57, IGDCC4, IGF2BP2, IGF2R, IGFBP3, IL16, IL6ST, INA, INHBA, INPP5K, INSIG1, INTU, IQCE, IQCG, ITGA11, ITGA8, ITGAV, ITGB5, ITGB8, ITIH1, ITM2C, ITPKA, ITSN1, IVD, KANSL3, KAT6B, KCNK2, KCNS1, KCNS2, KDM6A, KDSR, KIAA1033, KIAA1143, KIAA1199, KIAA1456, KIAA1462, KIAA1522, KIAA1524, KIAA1549, KIAA1715, KIAA1755, KIF14, KIF2A, KIF3A, KIT, KLC1, KLC2, KLF17, KLF6, KLHL7, KLRG1, KMT2D, KRT7, KRT18, KRT19, KRT34, KRTAP1-1, KRTAP1-5, KRTAP2-3, L3MBTL2, LAMA2, LAMB1, LAMB2P1, LARP4, LARP7, LATS2, LDLR, LEMD3, LETM2, LGALS8, LGI2, LGR4, LHX9, LIMS1, LINC00341, LINC00472, LINC00570, LINC00578, LINC00607, LINC00657, LINC00678, LINC00702, LINC00886, LINC00961, LINC01011, LINC01118, LINC01204, LMAN2L, LMO7, LMOD1, LOC400927, LONP1, LOX, LRBA, LRCH4, LRIG1, LRP4, LRP8, LRRC32, LRRC39, LRRC42, LRRC8A, LSAMP, LSS, LTBR, LUC7L2, LUM, LYPD1, LYRM1, LZTS2, MADD, MAFB, MAGED4, MAGED4B, MAMDC2, MAN1A2, MAN2A1, MAN2C1, MAP4K4, MAPK13, MASP1, MB, MB21D2, MBD1, MBOAT7, MC4R, MCM10, MDM2, MED1, MED13L, MEDAG, MEF2D, MEGF6, MEIS2, MEMO1, MEPCE, MFGE8, MFN2, MIAT, MICAL2, MINPP1, MIR612, MKL1, MKLN1, MKNK2, MLLT4, MLLT10, MLST8, MMAB, MMP10, MMP24, MMS19, MMS22L, MN1, MOXD1, MPPE1, MPZL1, MRPL3, MRPL45, MRPL55, MRPS28, MRVI1, MSANTD3, MSC, MSH2, MSH4, MSH6, MSL3, MSMO1, MSRB3, MTAP, MTERF3, MTERFD1, MTHFD1L, MTMR9, MTRR, MUM1, MVD, MVK, MXRA5, MYADM, MYCBP2, MYLK, MYO1D, MYO9B, MYOF, NA, NAA35, NAALADL2, NADK, NAE1, NAGS, NASP, NAV1, NAV2, NCOA1, NCOA3, NCOA4, NCSTN, NDNF, NELFA, NEO1, NEURL1B, NF2, NFE2L1, NFX1, NGF, NGFR, NHLH1, NID1, NID2, NIPA1, NKX3-1, NLN, NOL10, NOMO3, NOTCH3, NOTUM, NOVA2, NOX4, NPEPPS, NRD1, NREP, NRG1, NRROS, NSUN4, NT5C2, NT5E, NTNG1, NUDT4, NUP153, NUP35, NUP50, NUPL1, NUSAP1, OCLN, ODF2, OLR1, OS9, OSBPL6, OSBPL10, OSMR, OXCT1, OXCT2, P4HA1, P4HB, PABPC1, PAIP2B, PAK4, PAPD4, PARD3, PARN, PARP14, PARP4, PARVB, PBLD, PCBP2, PCBP4, PCDHGB3, PCGF3, PCM1, PCMTD2, PCNXL2, PCSK9, PDE1C, PDE4A, PDE5A, PDE7A, PDGFD, PDGFRB, PDLIM7, PDS5B, PDXDC1, PEAR1, PEPD, PEX5, PFKP, PHACTR3, PHF19, PHF8, PHRF1, PHTF2, PI4K2A, PIEZO1, PIGN, PIGU, PIK3C2B, PIK3CD, PIK3R1, PIKFYVE, PIM2, PITPNA, PITPNB, PITPNM1, PITPNM3, PLAU, PLEC, PLEK2, PLEKHA1, PLEKHA6, PLEKHB2, PLEKHH2, PLSCR1, PLSCR3, PLXNB2, PLXNC1, PMS1, PNISR, PODN, POLE3, POLN, POLR1A, POLR3D, POMT2, POSTN, POU2F1, PPAPDC1A, PPARA, PPARG, PPHLN1, PPIP5K1, PPIP5K2, PPM1E, PPP1R12A, PPP1R26, PPP3CA, PPP6R1, PPP6R2, PRKACB, PRKCA, PRKDC, PRKG1, PRMT1, PRNP, PRPF31, PRPH2, PRRG4, PRSS23, PRUNE2, PSMA4, PSMC1, PSMD6, PSMD6-AS2, PTGIS, PTK2B, PTPN14, PTX3, PUF60, PUS7, PVR, PXK, PXN, QKI, RAB23, RAB2B, RAB30, RAB34, RAB38, RAB44, RAD1, RAD9B, RAD23B, RAF1, RALB, RAP1A, RAP1GDS1, RAPGEF1, RARG, RARS, RARS2, RASSF8, RBBP8, RBCK1, RBFOX2, RBKS, RBM10, RCC1, RDX, RERE, RFTN1, RFWD2, RFX3-AS1, RGCC, RGS10, RGS3, RIF1, RNF14, RNF19A, RNF38, RNFT1, ROR1, ROR2, RPA1, RPL10, RPS10, RPS6KB2, RPS6KC1, RRBP1, RWDD4, SAMD4A, SAMD9, SAMD9L, SAR1A, SART3, SCAF4, SCAF8, SCARNA9, SCD, SCLT1, SCO1, SDCBP, SEC14L1, SEC22A, SEC24A, SEC24B, SEC61A1, SENP6, SEPT9, SERGEF, SERPINE2, SF1, SGK3, SGOL2, SH3RF1, SH3YL1, SHROOM3, SIGLEC10, SKA2, SKIL, SLC12A2, SLC24A3, SLC25A17, SLC35F3, SLC39A3, SLC39A10, SLC4A4, SLC4A11, SLC41A1, SLC44A2, SLC46A2, SLC6A15, SLC7A6, SLC7A8, SLC7A11, SLC9A3, SLIT3, SMARCA4, SMARCC2, SMC4, SMC6, SMCHD1, SMG1, SMG1P3, SMN2, SMPD4, SMTN, SMYD3, SMYD5, SNAP23, SNED1, SNHG16, SNX7, SNX14, SOCS2, SON, SORBS2, SORCS2, SOS2, SOX7, SPATA18, SPATA20, SPATA5, SPATS2, SPDYA, SPEF1, SPG20, SPIDR, SPRED2, SPRYD7, SQLE, SQRDL, SQSTM1, SRCAP, SREBF1, SREK1, SRGAP1, SRRM1, SRSF3, STAC2, STARD4, STAT1, STAT3, STAT4, STAU1, STC2, STEAP2, STK32B, STRIP1, STRN3, STRN4, STS, STX16, STXBP6, SULF1, SUPT20H, SVEP1, SYNE1, SYNE2, SYNGR2, SYNPO, SYNPO2, SYNPO2L, SYT15, SYTL2, TACC1, TAF2, TAGLN3, TANC2, TANGO6, TARBP1, TARS, TASP1, TBC1D15, TBL2, TCF12, TCF4, TCF7L2, TENC1, TENM2, TEP1, TET3, TEX21P, TFCP2, TGFA, TGFB2, TGFB3, TGFBI, TGFBR1, TGFBRAP1, TGM2, THADA, THAP4, THBS2, THRB, TIAM1, TIMP2, TJP2, TLE3, TLK1, TMC3, TMEM102, TMEM119, TMEM134, TMEM154, TMEM189-UBE2V1, TMEM214, TMEM256-PLSCR3, TMEM47, TMEM50B, TMEM63A, TNC, TNFAIP3, TNFAIP8L3, TNFRSF12A, TNFRSF14, TNIP1, TNKS1BP1, TNPO3, TNRC18P1, TNRC6A, TNS1, TNS3, TNXB, TOE1, TOMM40, TOMM5, TOPORS, TP53AIP1, TP53INP1, TPRG1, TRAF3, TRAK1, TRAPPC12, TRIB1, TRIM2, TRIM23, TRIM26, TRIM28, TRIM65, TRIM66, TRMT1L, TRPC4, TRPS1, TSC2, TSHZ1, TSHZ2, TSPAN11, TSPAN18, TSPAN2, TSPAN7, TSSK3, TTC7A, TTC7B, TUBB2C, TUBB3, TUBE1, TXNIP, TXNL1, TXNRD1, TYW5, U2SURP, UBAP2L, UBE2G2, UBE2V1, UBQLN4, UCHL5, UHMK1, UHRF1BP1L, UNC5B, URGCP, USP19, USP7, USP27X, UVRAG, VANGL1, VARS2, VAV2, VCL, VIM-AS1, VIPAS39, VPS13A, VP529, VPS41, VPS51, VSTM2L, VWA8, VWF, WDR19, WDR27, WDR37, WDR48, WDR91, WIPF1, WISP1, WNK1, WNT5B, WNT10B, WSB1, WWTR1, XIAP, XRN2, YAP1, YDJC, YES1, YPEL5, YTHDF3, Z24749, ZAK, ZBTB10, ZBTB24, ZBTB26, ZBTB7A, ZC3H12C, ZC3H14, ZC3H18, ZCCHC5, ZCCHC8, ZCCHC11, ZEB1, ZEB2, ZFAND1, ZFAND5, ZFP82, ZHX3, ZMIZ1, ZMIZ1-AS1, ZMYM2, ZNF12, ZNF138, ZNF148, ZNF212, ZNF219, ZNF227, ZNF232, ZNF24, ZNF268, ZNF28, ZNF281, ZNF335, ZNF350, ZNF37A, ZNF37BP, ZNF395, ZNF431, ZNF583, ZNF621, ZNF652, ZNF655, ZNF660, ZNF674, ZNF680, ZNF74, ZNF764, ZNF778, ZNF780A, ZNF79, ZNF827, ZNF837, ZNF839 or ZNF91

Table 2 shows certain genes that are expected to demonstrate an effect on inclusion of an iExon with a corresponding change in isoform abundance as a result of iExon generation in RNA having intronic REMS elements in the presence of a compound as described herein. The change in abundance is expected to have a statistically significant p value.

TABLE 2

ABCA1, ABCB7, ABCC1, ABHD10, ABL2, ABLIM3, ACACA, ACADVL, ACAT2, ADAM12, ADAM15, ADAM17, ADAM33, AFF2, AGK, AGPAT3, AGPS, AHCYL2, AHDC1, AHRR, AJUBA, AK021888, AK310472, AKAP1, AKAP9, AKNA, ALCAM, ALDH4A1, AMPD2, ANK2, ANKFY1, ANKHD1-EIF4EBP3, ANKRD17, ANKS6, ANP32A, ANXA11, ANXA6, AP2B1, APAF1, APLP2, APP, APPL2, APTX, ARHGAP22, ARID1A, ARID2, ARNICX3, ASAP1, ASL, ASNS, ASPH, ATAD2B, ATF7IP, ATG9A, ATMIN, ATP2C1, ATXN3, AURKA, AXIN1, B4GALT2, BACE1, BAG2, BASP1, BC033281, BCAR3, BEND6, BICD1, BIN1, BNC1, BRD2, BRPF1, BSCL2, BTBD10, BZW1, C11orf30, C11orf73, C17orf76-AS1, C4orf27, C5orf24, C6orf48, C9orf69, CAB39, CALU, CAMKK1, CAPNS1, CASC3, CASP8AP2, CAV1, CCAR1, CCDC77, CCDC88A, CCDC92, CCT6A, CD276, CD46, CDC25B, CDC40, CDC42BPA, CDCA7, CDH11, CDH13, CDK11B, CDK16, CDKAL1, CEP68, CFLAR, CHD8, CIZ1, CLIC1, CLK4, CNOT1, COG1, COL12A1, COL1A1, COL6A1, COPS7B, CPEB2, CREB5, CRLS1, CRTAP, CSDE1, CSNK1A1, CTDSP2, CTNND1, CUL2, CUL4A, CUX1, CYB5B, CYBRD1, CYP51A1, DAB2, DACT1, DARS, DAXX, DCAF10, DCAF11, DCBLD2, DCUN1D4, DDAH1, DDAH2, DDHD2, DDR1, DDX39B, DDX42, DENND1A, DENND1B, DENND5A, DGCR2, DGKA, DHCR24, DHCR7, DHFR, DHX9, DIAPH1, DIAPH3, DIS3L, DKFZp434M1735, DKK3, DLC1, DNM2, DOCK1, DPP8, DSEL, DST, DSTN, EBF1, EEA1, EEF1A1, EFCAB14, EGR1, EHMT2, EIF2B3, EIF4G1, EIF4G2, EIF4G3, ELF2, ENG, ENPP2, ENSA, EPN1, EPT1, ERC1, ERGIC3, ETV5, EXO1, EXTL2, EYA3, FADS1, FADS2, FAF1, FAM111A, FAM198B, FAM219A, FAM219B, FAM3C, FAM65A, FBXO10, FBXO18, FBXO31, FBXO34, FBXO9, FDFT1, FDPS, FER, FEZ1, FGD5-AS1, FGFRL1, FHOD3, FLII, FLNB, FN1, FNBP1, FOCAD, FOS, FOSB, FOSL1, FOXK1, FOXM1, FUS, FYN, GABPB1, GALC, GALNT1, GAS7, GBA2, GCFC2, GGCT, GHDC, GIGYF2, GJC1, GMIP, GNA13, GNAS, GNL3L, GOLGA2, GOLGA4, GOLGB1, GORASP1, GPR1, GPR89A, GPSM2, GREM1, GRK6, GSE1, GTF2H2B, HAS2, HAT1, HAUS3, HAUS6, HDAC7, HEG1, HLA-A, HLA-E, HLTF, HMGA1, HMGB1, HMGCR, HMGCS1, HMOX1, HNRNPR, HNRNPUL1, HP1BP3, HRH1, HSD17B12, HSD17B4, HTT, TARS, IDH1, IDI1, IGF2BP2, IL6ST, INHBA, INSIG1, IQCE, ITGAV, ITGB5, ITM2C, ITSN1, KANSL3, KCNK2, KIAA1033, KIAA1143, KIAA1199, KIAA1522, KIAA1524, KIAA1549, KIAA1715, KIF14, KIF2A, KIF3A, KLC1, KLC2, KLF6, KLHL7, KRT18, KRT19, KRT34, KRTAP2-3, LAMA2, LAMB1, LARP4, LARP7, LATS2, LDLR, LEMD3, LGALS8, LIMS1, LINC00341, LINC00657, LMAN2L, LM07, LONP1, LOX, LRCH4, LRIG1, LRP8, LRRC8A, LSS, LTBR, LUC7L2, LZTS2, MADD, MAGED4, MAGED4B, MAN1A2, MAP4K4, MBD1, MBOAT7, MDM2, MEDI, MEDAG, MEF2D, MEIS2, MEMO1, MEPCE, MFGE8, MICAL2, MINPP1, MKL1, MKLN1, MKNK2, MLLT4, MLST8, MMAB, MMS19, MMS22L, MPPE1, MPZL1, MRPL3, MSANTD3, MSC, MSH2, MSH6, MSL3, MSMO1, MSRB3, MTAP, MTERFD1, MTHFD1L, MTMR9, MTRR, MUM1, MVD, MVK, MYADM, MYLK, MYO1D, MYO9B, MYOF, NAA35, NADK, NASP, NAV1, NAV2, NCOA1, NCOA3, NCOA4, NCSTN, NELFA, NEO1, NEURL1B, NF2, NFE2L1, NFX1, NID1, NID2, NIPA1, NKX3-1, NOL10, NOMO3, NPEPPS, NRD1, NREP, NRG1, NSUN4, NT5C2, NT5E, NTNG1, NUDT4, NUP153, NUP35, NUP50, NUPL1, NUSAP1, ODF2, OS9, OSBPL6, OSMR, P4HA1, P4HB, PABPC1, PAK4, PAPD4, PARD3, PARN, PARP14, PARP4, PARVB, PCBP2, PCBP4, PCDHGB3, PCGF3, PCM1, PCMTD2, PCNXL2, PCSK9, PDE4A, PDE7A, PDLIM7, PDXDC1, PEPD, PEX5, PFKP, PHF19, PHF8, PHRF1, PHTF2, PI4K2A, PIEZO1, PIGU, PIK3C2B, PITPNA, PITPNB, PITPNM1, PLAU, PLEC, PLEKHB2, PLSCR3, PLXNB2, PLXNC1, PMS1, POLE3, POLR3D, POSTN, POU2F1, PPAPDC1A, PPARA, PPHLN1, PPIP5K1, PPP1R12A, PPP6R1, PPP6R2, PRKACB, PRKDC, PRMT1, PRNP, PR5523, PSMA4, PSMC1, PSMD6, PTK2B, PTPN14, PUF60, PUS7, PVR, PXN, QKI, RAB23, RAB2B, RAB34, RAD1, RAD23B, RALB, RAP1A, RAP1GDS1, RARG, RASSF8, RBCK1, RBFOX2, RBM10, RCC1, RFTN1, RFWD2, RGS10, RGS3, RIF1, RNF14, RNF19A, RNF38, RNFT1, RPL10, RPS6KC1, RRBP1, RWDD4, SAMD9, SAMD9L, SAR1A, SART3, SCAF4, SCAF8, SCD, SCLT1, SCO1, SDCBP, SEC14L1, SEC22A, SEC24B, SEC61A1, SEPT9, SERPINE2, SF1, SGOL2, SH3RF1, SKIL, SLC25A17, SLC39A3, SLC41A1, SLC4A4, SLC7A6, SLC7A8, SMARCA4, SMARCC2, SMC4, SMC6, SMCHD1, SMG1, SMN2, SMPD4, SMYD3, SMYD5, SNAP23, SNHG16, SNX14, SOCS2, SON, SOS2, SPATA20, SPATS2, SPG20, SPRED2, SQLE, SQRDL, SQSTM1, TABLE 2-continued SRCAP, SREBF1, SREK1, SRSF3, STARD4, STAT1, STAT3, STAU1, STC2, STEAP2, STRIP1, STRN3, STX16, SUPT2OH, SYNE1, SYNE2, SYT15, SYTL2, TACC1, TAF2, TANC2, TARBP1, TARS, TBC1D15, TBL2, TCF7L2, TENC1, TENM2, TEP1, TET3, TFCP2, TGFBI, TGFBR1, TGFBRAP1, THADA, THAP4, THRB, TIMP2, TJP2, TLE3, TLK1, TMEM154, TMEM47, TMEM63A, TNC, TNFAIP3, TNFRSF12A, TNIP1, TNKS1BP1, TNPO3, TNS1, TNS3, TOE1, TOMM40, TOMM5, TOPORS, TP53INP1, TRAF3, TRAK1, TRAPPC12, TRIB1, TRIM2, TRIM23, TRIM26, TRIM28, TRIM65, TRMT1L, TRPS1, TSC2, TSHZ1, TSPAN2, TTC7A, TUBB2C, TUBB3, TXNL1, TXNRD1, U2SURP, UBAP2L, UBE2G2, UBE2V1, UBQLN4, UCHL5, UHMK1, UHRF1BP1L, UNC5B, USP19, USP7, VANGL1, VARS2, VCL, VIPAS39, VPS13A, VP529, VPS51, VWA8, WDR19, WDR37, WDR48, WIPF1, WNT5B, WSB1, WWTR1, XIAP, XRN2, YAP1, YES1, YPEL5, YTHDF3, Z24749, ZAK, ZBTB10, ZBTB24, ZBTB7A, ZC3H12C, ZC3H14, ZC3H18, ZCCHC11, ZEB1, ZEB2, ZFAND1, ZFAND5, ZHX3, ZMIZ1, ZMYM2, ZNF12, ZNF148, ZNF219, ZNF227, ZNF24, ZNF268, ZNF28, ZNF281, ZNF335, ZNF37A, ZNF37BP, ZNF395, ZNF583, ZNF621, ZNF652, ZNF655, ZNF674, ZNF74, ZNF764, ZNF778, ZNF780A, ZNF827, ZNF839 or ZNF91

Table 3 shows certain genes that are expected to demonstrate an effect on inclusion of an iExon with a corresponding change in isoform abundance as a result of iExon generation in RNA having intronic REMS elements in the presence of a compound as described herein. The change in abundance is expected to have a statistically significant p value.

TABLE 3

ABCA1, ABCC1, ABL2, ACACA, ACAT2, AFF2, AHRR, AK021888, AK310472, AKAP1, ANK2, ANKHD1-EIF4EBP3, AP2B1, APAF1, APLP2, ARID1A, ARMCX3, ASAP1, ASPH, ATAD2B, ATF7IP, ATG9A, AXIN1, BACE1, BIN1, BNC1, BRPF1, BZW1, C11orf30, C11orf73, C17orf76-AS1, C4orf27, C6orf48, CAB39, CAMKK1, CCDC88A, CCDC92, CDC25B, CDC42BPA, CDCA7, CDH11, CDH13, CEP68, CFLAR, COPS7B, CREB5, CUL2, CUL4A, CUX1, CYP51A1, DCUN1D4, DDR1, DDX39B, DDX42, DENND1A, DENND5A, DGKA, DHCR24, DHCR7, DIAPH1, DIAPH3, DNM2, DOCK1, EFCAB14, EIF2B3, EPN1, EPT1, ERC1, ETV5, FADS1, FADS2, FAF1, FAM198B, FAM219B, FBXO10, FBXO9, FDFT1, FDPS, FER, FEZ1, FHOD3, FLII, FLNB, FNBP1, FOS, FOSB, FOXMl, FYN, GABPB1, GALC, GAS7, GGCT, GJC1, GPSM2, GRK6, HAS2, HAT1, HLTF, HMGA1, HMGB1, HMGCR, HMGCS1, HMOX1, HP1BP3, HSD17B12, HTT, IDI1, INHBA, INSIG1, KANSL3, KIAA1199, KIAA1524, KIAA1715, KIF3A, KLF6, KRT19, KRT34, KRTAP2-3, LAMA2, LARP7, LDLR, LEMD3, LMAN2L, LRCH4, LRP8, LSS, MAGED4, MAGED4B, MAN1A2, MEDAG, MEF2D, MEMO1, MFGE8, MICAL2, MMAB, MMS19, MMS22L, MSL3, MSM01, MTAP, MTERFD1, MVD, MVK, NASP, NAV2, NEURL1B, NFE2L1, NID1, NPEPPS, NREP, NRG1, NSUN4, NT5C2, NUP153, P4HA1, PABPC1, PAPD4, PCBP2, PCM1, PCSK9, PDXDC1, PEPD, PHF19, PHF8, PHTF2, PIK3C2B, PITPNB, PLEC, PMS1, POU2F1, PPHLN1, PRKDC, PRSS23, PSMC1, PTPN14, PUF60, PVR, RAB23, RAD23B, RAP1A, RASSF8, RBM10, RCC1, RFWD2, RNFT1, RWDD4, SAMD9L, SART3, SCAF4, SCD, SEC22A, SEC61A1, SERPINE2, SF1, SLC25A17, SLC7A6, SLC7A8, SMN2, SMYD3, SMYD5, SNAP23, SNHG16, SQLE, SQRDL, SQSTM1, SRCAP, SREBF1, STARD4, STAT1, STAU1, STEAP2, STRN3, SYNE1, TACC1, TAF2, TANC2, TARBP1, TBC1D15, TEP1, TFCP2, TGFBRAP1, THADA, TIMP2, TLK1, TMEM154, TNS3, TOMM5, TRAF3, TRAK1, TRAPPC12, TRIM2, TRIM26, TRIM65, TSPAN2, U2SURP, UBAP2L, UBE2V1, UCHL5, UHRF1BP1L, VANGL1, VARS2, VPS13A, VPS29, VWA8, WSB1, XIAP, XRN2, YPEL5, ZAK, ZC3H18, ZFAND5, ZMIZ1, ZMYM2, ZNF219, ZNF227, ZNF24, ZNF37A, ZNF37BP, ZNF395, ZNF652, ZNF674, ZNF74 or ZNF778

Table 4 shows certain genes that are expected to demonstrate an effect on inclusion of an iExon with a corresponding change in isoform abundance as a result of iExon generation in RNA having intronic REMS elements in the presence of a compound as described herein. The change in abundance is expected to have a statistically significant p value.

TABLE 4

ABCC1, ACADVL, ADAM15, AGPAT3, AHRR, AJUBA, AKAP1, AKAP9, ALCAM, ALDH4A1, ANKFY1, AP2B1, APLP2, APP, ARID1A, ARID2, ASPH, ATMIN, BASP1, BC033281, BCAR3, C11orf73, C17orf76-AS1, C5orf24, C6orf48, CAB39, CASP8AP2, CAV1, CCAR1, CCT6A, CD276, CD46, CDC25B, CDK16, CEP68, CHD8, CLIC1, COL12A1, CPEB2, CREB5, CRLS1, CRTAP, CTNND1, CUX1, CYBRD1, DACT1, DCAF10, DCAF11, DDHD2, DDX39B, DIAPH3, DKK3, DLC1, DSTN, EBF1, EGR1, EIF4G1, EIF4G3, ENG, ERC1, ETV5, FAM198B, FAM219A, FAM3C, FEZ1, FGD5-AS1, FLIT, FN1, FNBP1, FOS, FOSB, FOXK1, FOXM1, FYN, GABPB1, GALC, GALNT1, GBA2, GGCT, GHDC, GMIP, GNA13, GNAS, GNL3L, GOLGA2, GORASP1, GREM1, GSE1, HAUS6, HDAC7, HEG1, HLA-A, HLA-E, HMGA1, HP1BP3, IL6ST, ITGAV, KIAA1549, KIF14, KLC1, KLF6, KLHL7, KRT18, LAMA2, LAMB1, LARP7, LATS2, LGALS8, LIMS1, LINC00341, LONP1, LOX, MDM2, MEPCE, MINPP1, MLLT4, MPPE1, MRPL3, MSH2, MSH6, MSL3, MTMR9, MTRR, MUM1, MYADM, MYLK, NASP, NAV2, NCSTN, NFE2L1, NID1, NIPA1, NPEPPS, NRD1, NUDT4, NUSAP1, P4HB, PABPC1, PAK4, PAPD4, PCNXL2, PDE4A, PDXDC1, PHRF1, PHTF2, PI4K2A, PIK3C2B, PLAU, PLEKHB2, PLSCR3, PLXNB2, POSTN, POU2F1, PPARA, PPP1R12A, PRKACB, PSMD6, PTPN14, PUS7, QKI, RAB34, RAD1, RAD23B, RASSF8, RBCK1, RBFOX, RFTN1, RNF19A, RNF38, RPS6KC1, RWDD4, SEC14L1, SEC24B, SERPINE2, SF1, SLC39A3, SLC41A1, SLC4A4, SLC7A6, SMARCA4, SMN2, SNHG16, SNX14, SON, SPRED2, STAU1, STEAP2, STRIP1, STRN3, TBL2, TGFBI, TGFBR1, THAP4, TLE3, TMEM47, TNKS1BP1, TOMM40, TOPORS, TRAK1, TRAPPC12, TRIB1, TRIM2, TRIM23, TRIM65, TRMT1L, TRPS1, TXNL1, TXNRD1, U2SURP, UBE2G2, UBE2V1, UHMK1, USP7, VP529, VWA8, WDR19, WDR37, WIPF1, YPEL5, YTHDF3, Z24749, ZBTB10, ZBTB7A, ZFAND5, ZMIZ1, ZNF12, ZNF148, ZNF335, ZNF395, ZNF583, ZNF621, ZNF655, ZNF74 or ZNF780A Table 5 shows certain genes that are expected to demonstrate an effect on inclusion of an iExon with a corresponding change in isoform abundance as a result of iExon generation in RNA having intronic REMS elements in the presence of a compound as described herein. The change in abundance is expected to have a statistically significant p value.

TABLE 5

ABCB7, ABHD10, ABLIM3, ACACA, ADAM12, ADAM17, ADAM33, AGK, AGPS, AHCYL2, AHDC1, AHRR, AK021888, AK310472, AKAP1, AKAP9, AKNA, AMPD2, ANKRD17, ANKS6, ANP32A, ANXA11, ANXA6, APLP2, APP, APPL2, APTX, ARHGAP22, ARMCX3, ASAP1, ASNS, ASPH, ATG9A, ATP2C1, AURKA, AXIN1, B4GALT2, BACE1, BASP1, BEND6, BICD1, BIN1, BRD2, BRPF1, BTBD10, C11orf30, C11orf73, C17orf76-AS1, C4orf27, C6orf48, CAB39, CAPNS1, CASC3, CCDC77, CCDC88A, CD46, CDC40, CDC42BPA, CDCA7, CDH13, CDK11B, CEP68, CIZ1, CLK4, CNOT1, COG1, COL12A1, COL1A1, COL6A1, COPS7B, CSDE1, CSNK1A1, CUX1, CYB5B, CYBRD1, DAB2, DARS, DCBLD2, DCUN1D4, DDAH1, DDR1, DDX39B, DDX42, DENND1A, DENND1B, DENND5A, DGKA, DHFR, DHX9, DIAPH1, DIAPH3, DIS3L, DNM2, DOCK1, DPP8, DSEL, EEA1, EFCAB14, EIF2B3, EIF4G1, EIF4G3, ELF2, ENG, ENPP2, EPN1, EXTL2, EYA3, FAF1, FAM198B, FAM3C, FBXO10, FBXO18, FBXO31, FBXO9, FER, FEZ1, FHOD3, FLIT, FN1, FNBP1, FOCAD, FOSL1, FOXM1, GABPB1, GALC, GALNT1, GCFC2, GGCT, GIGYF2, GMIP, GNAS, GNL3L, GOLGB1, GPR89A, GPSM2, GREM1, GRK6, GTF2H2B, HAT1, HAUS3, HEG1, HLA-A, HLTF, HP1BP3, HRH1, HSD17B12, HSD17B4, HTT, TARS, IDH1, IGF2BP2, ITM2C, KCNK2, KIAA1033, KIAA1143, KIAA1522, KIAA1524, KIAA1715, KIF3A, KLHL7, LAMA2, LARP4, LARP7, LATS2, LIMS1, LINC00341, LINC00657, LMAN2L, LMO7, LRCH4, LRIG1, LRRC8A, LTBR, LUC7L2, LZTS2, MADD, MAGED4B, MAN1A2, MAP4K4, MED1, MEDAG, MEF2D, MEIS2, MEMO1, MICAL2, MKLN1, MLLT4, MMS19, MPZL1, MSANTD3, MSC, MSL3, MTAP, MTERFD1, MTHFD1L, MYADM, MYLK, MYO9B, MYOF, NASP, NAV2, NCOA3, NCOA4, NELFA, NEO1, NEURL1B, NF2, NID2, NOL10, NPEPPS, NRG1, NSUN4, NT5C2, NT5E, NTNG1, NUP153, NUP35, NUP50, NUSAP1, ODF2, OS9, OSBPL6, P4HA1, P4HB, PABPC1, PAPD4, PARN, PARP4, PCBP2, PCBP4, PCDHGB3, PCGF3, PCM1, PCMTD2, PDE7A, PDXDC1, PEPD, PFKP, PHF19, PHRF1, PHTF2,

TABLE 5-continued

PIEZO1, PIGU, PITPNA, PITPNB, PITPNM1, PLAU, PLSCR3, PLXNC1, PMS1, POU2F1, PPAPDC1A, PPHLN1, PPIP5K1, PPP1R12A, PRKDC, PRMT1, PRSS23, PSMA4, PTK2B, PUF60, PVR, RAB23, RAB2B, RAD1, RAD23B, RAP1A, RAP1GDS1, RARG, RASSF8, RBCK1, RCC1, RFWD2, RGS3, RNF14, RNFT1, RPL10, RRBP1, RWDD4, SAR1A, SCAF4, SCAF8, SCLT1, SCO1, SDCBP, SEC22A, SEPT9, SF1, SGOL2, SLC25A17, SLC4A4, SLC7A6, SMARCC2, SMC4, SMC6, SMCHD1, SMN2, SMPD4, SMYD3, SNAP23, SNHG16, SOCS2, SOS2, SPATA20, SPATS2, SPG20, SQRDL, SREBF1, SREK1, SRSF3, STAT1, STAU1, STEAP2, STRN3, STX16, SUPT20H, SYNE1, SYNE2, SYT15, SYTL2, TAF2, TARBP1, TARS, TBL2, TCF7L2, TENC1, TENM2, TEP1, TET3, TGFBR1, THADA, THRB, TJP2, TLE3, TMEM47, TMEM63A, TNFAIP3, TNIP1, TNPO3, TNS1, TNS3, TOE1, TOMM5, TP53INP1, TRAF3, TRAPPC12, TRIM2, TRIM23, TRIM65, TSC2, TSPAN2, TUBB2C, TXNRD1, UBAP2L, UBE2V1, UCHL5, USP19, VANGL1, VIPAS39, VP529, VPS51, VWA8, WDR48, WNT5B, WSB1, WWTR1, XRN2, YAP1, YES1, YPEL5, YTHDF3, Z24749, ZBTB24, ZC3H14, ZFAND1, ZFAND5, ZHX3, ZMIZ1, ZMYM2, ZNF219, ZNF268, ZNF395, ZNF827 or ZNF91

Table 6 shows certain genes that are expected to demonstrate an effect on inclusion of an iExon with a corresponding change in isoform abundance as a result of iExon generation in RNA having intronic REMS elements in the presence of a compound as described herein. The change in abundance is expected to have a statistically significant p value.

TABLE 6

ACACA, ACADVL, AFF2, AHCYL2, AHRR, AKAP1, ALDH4A1, ANKRD17, AP2B1, APLP2, ASL, ASPH, ATG9A, ATMIN, ATXN3, BAG2, BASP1, BRPF1, BSCL2, C11orf30, C11orf73, C17orf76-AS1, C6orf48, C9orf69, CAB39, CALU, CDC25B, CDC42BPA, CDKAL1, CLIC1, COL12A1, COL1A1, COL6A1, CSNK1A1, CTDSP2, CUL2, CUL4A, DAXX, DCAF10, DDAH1, DDR1, DDX39B, DENND1A, DGCR2, DKFZp434M1735, DKK3, DNM2, DST, EEF1A1, EFCAB14, EHMT2, EIF4G1, EIF4G2, EIF4G3, ENSA, EXO1, FAM111A, FAM198B, FAM65A, FBXO34, FEZ1, FGD5-AS1, FGFRL1, FLII, FN1, FOXK1, FOXM1, FUS, GALC, GALNT1, GAS7, GCFC2, GGCT, GJC1, GNA13, GNL3L, GOLGA4, GPR1, GREM1, HEG1, HLA-A, HLA-E, HLTF, HNRNPR, HNRNPUL1, IQCE, ITGB5, ITSN1, KIAA1033, KIF2A, KIF3A, KLC2, LATS2, LIMS1, LINC00341, LINC00657, LONP1, LOX, LUC7L2, MBD1, MBOAT7, MEF2D, MEIS2, MICAL2, MKL1, MKNK2, MLST8, MPPE1, MSL3, MSRB3, MTRR, MYADM, MYLK, MYO1D, NAA35, NAV1, NAV2, NCOA1, NFX1, NKX3-1, NOMO3, NRG1, NUDT4, NUPL1, NUSAP1, OSMR, P4HA1, P4HB, PAPD4, PARD3, PARN, PARP14, PARVB, PCBP2, PCBP4, PCGF3, PDLIM7, PDXDC1, PEX5, PFKP, PHRF1, PI4K2A, POLE3, POLR3D, POSTN, PPARA, PPP6R1, PPP6R2, PRNP, PXN, RAB34, RAD23B, RALB, RAP1A, RASSF8, RBCK1, RBFOX2, RGS10, RIF1, RNF14, RNF19A, SAMD9, SCAF4, SDCBP, SERPINE2, SF1, SH3RF1, SKIL, SLC25A17, SLC4A4, SMG1, SMN2, SNHG16, SREBF1, STAT3, STC2, STEAP2, STRN3, SYNE1, SYNE2, TACC1, TARS, TGFBI, TMEM47, TNC, TNFRSF12A, TNS1, TRAF3, TRIM28, TSC2, TSHZ1, TTC7A, TUBB2C, TUBB3, TXNL1, TXNRD1, UBE2G2, UBE2V1, UBQLN4, UNC5B, USP19, VARS2, VCL, VPS29, WDR37, WIPF1, WWTR1, ZC3H12C, ZCCHC11, ZEB1, ZEB2, ZFAND1, ZFAND5, ZMIZ1, ZNF28, ZNF281, ZNF655, ZNF764 or ZNF839

Table 7 shows genes that demonstrate an effect on change in isoform abundance as a result of having intronic REMS elements in the presence of Compound 774 (at doses ranging from 0.3 µM to 3 µM), having statistically significant adjusted Fisher's Exact Test p value.

TABLE 7

ABCB8, ABCC3, ADAM17, ADCY3, AGPAT4, ANKRA2, ANXA11, APIP, APLP2, APPL2, ARHGAP1, ARL15, ASAP1, ASPH, ATAD2B, ATXN1, AXIN1, BECN1, BHMT2, BICD1, BTN3A1, C11orf30, C11orf73, C12orf4, C14orf132, C8orf44, C8orf44-SGK3, C8orf88,

TABLE 7-continued

CASC3, CASP7, CCDC122, CDH13, CECR7, CENPI, CEP112,
CEP192, CHEK1, CMAHP, CNRIP1, COPS7B, CPSF4, CRISPLD2,
CRYBG3, CSNK1E, CSNK1G1, DAGLB, DCAF17, DCUN1D4,
DDX42, DENND1A, DENND5A, DGKA, DHFR, DIAPH3, DLGAP4,
DNAJC13, DNMBP, DOCK1, DYRK1A, EIF2B3, ENAH, ENOX1,
EP300, ERC1, ERCC1, ERGIC3, ERLIN2, ERRFI1, EVC, FAF1,
FAIM, FAM126A, FAM13A, FAM162A, FAM174A, FAM198B,
FBN2, FER, FHOD3, FOCAD, GALC, GCFC2, GGACT, GGCT,
GLCE, GOLGA4, GOLGB1, GPSM2, GULP1, GXYLT1, HAT1, HDX,
HLTF, HMGA2, HNMT, HPS1, HSD17B12, HSD17B4, HTT, IFT57,
INPP5K, IVD, KDM6A, KIAA1524, KIAA1715, LETM2, LOC400927,
LRRC42, LUC7L3, LYRM1, MADD, MB21D2, MCM10, MED13L,
MEDAG, MEMO1, MFN2, MMS19, MRPL45, MRPS28, MTERF3,
MYCBP2, MYLK, MYOF, NGF, NREP, NSUN4, NT5C2, OSMR,
OXCT1, PAPD4, PCM1, PDE7A, PDS5B, PDXDC1, PIGN, PIK3CD,
PIK3R1, PIKFYVE, PITPNB, PLEKHA1, PLSCR1, PMS1, POMT2,
PPARG, PPHLN1, PPIP5K2, PPP1R26, PRPF31, PRSS23, PRUNE2,
PSMA4, PXK, RAF1, RAP1A, RAPGEF1, RARS2, RBKS, RERE,
RFWD2, RNFT1, RPA1, RPS10, RPS6KB2, SAMD4A, SAR1A, SCO1,
SEC24A, SENP6, SERGEF, SGK3, SH3YL1, SKA2, SLC12A2,
SLC25A17, SLC44A2, SMYD3, SNAP23, SNHG16, SNX7, SOS2,
SPATA18, SPATA5, SPIDR, SPRYD7, SRGAP1, SRRM1, STAT1,
STRN3, STXBP6, SUPT2OH, TAF2, TASP1, TBC1D15, TCF12,
TCF4, TIAM1, TJP2, TMC3, TMEM189-UBE2V1, TMEM214,
TNRC6A, TNS3, TOE1, TRAF3, TRIM65, TSPAN2, TTC7B, TUBE1,
TYW5, UBAP2L, UBE2V1, URGCP, VAV2, VPS29, WDR27,
WDR37, WDR91, WNK1, XRN2, ZCCHC8, ZFP82, ZNF138, ZNF232,
ZNF37BP or ZNF680

Table 7a shows genes that demonstrate an effect on inclusion of an iExon with a corresponding change in isoform abundance as a result of having intronic REMS elements in the presence of Compound 774 (at doses ranging from 0.3 µM to 3 µM), having statistically significant adjusted Fisher's Exact Test p value.

TABLE 7a

ABCB8, ABCC3, ADAM17, ADCY3, AGPAT4, ANKRA2, ANXA11,
APIP, APPL2, ARHGAP1, ARL15, ASAP1, ASPH, ATAD2B, ATXN1,
BECN1, BHMT2, BICD1, BTN3A1, C11orf30, C11orf73, C12orf4,
C14orf132, C8orf44, C8orf44-SGK3, C8orf88, CASC3, CASP7,
CCDC122, CDH13, CECR7, CENPI, CEP112, CEP192, CHEK1,
CMAHP, CNRIP1, COPS7B, CPSF4, CRISPLD2, CRYBG3, CSNK1E,
CSNK1G1, DCAF17, DCUN1D4, DDX42, DENND1A, DENND5A,
DGKA, DHFR, DIAPH3, DNAJC13, DNMBP, DOCK1, DYRK1A,
EIF2B3, ENAH, ENOX1, EP300, ERC1, ERLIN2, ERRFI1, EVC, FAF1,
FAIM, FAM126A, FAM13A, FAM162A, FAM174A, FBN2, FER,
FHOD3, FOCAD, GALC, GCFC2, GGACT, GLCE, GOLGA4,
GOLGB1, GPSM2, GULP1, GXYLT1, HDX, HLTF, HMGA2, HNMT,
HSD17B12, HSD17B4, HTT, IFT57, IVD, KDM6A, KIAA1524,
KIAA1715, LETM2, LOC400927, LRRC42, LUC7L3, LYRM1,
MB21D2, MCM10, MED13L, MEDAG, MEMO1, MFN2, MMS19,
MRPL45, MRPS28, MTERF3, MYCBP2, MYLK, MYOF, NGF, NREP,
NSUN4, NT5C2, OSMR, OXCT1, PAPD4, PCM1, PDE7A, PDS5B,
PDXDC1, PIGN, PIK3CD, PIK3R1, PIKFYVE, PITPNB, PLEKHA1,
PLSCR1, PMS1, POMT2, PPARG, PPIP5K2, PPP1R26, PRPF31,
PRSS23, PSMA4, PXK, RAF1, RAPGEF1, RARS2, RBKS, RERE,
RFWD2, RPA1, RPS10, SAMD4A, SAR1A, SCO1, SEC24A, SENP6,
SERGEF, SGK3, SLC12A2, SLC25A17, SLC44A2, SMYD3, SNAP23,
SNHG16, SNX7, SOS2, SPATA5, SPIDR, SPRYD7, SRGAP1, SRRM1,
STAT1, STXBP6, SUPT2OH, TAF2, TASP1, TBC1D15, TCF12, TCF4,
TIAM1, TJP2, TMC3, TMEM214, TNRC6A, TNS3, TOE1, TRAF3,
TSPAN2, TTC7B, TYW5, UBAP2L, URGCP, VAV2, WDR27, WDR37,
WDR91, WNK1, XRN2, ZCCHC8, ZFP82, ZNF138, ZNF232 or
ZNF37BP Table 7b shows genes that demonstrate an effect on inclusion of an exon with a corresponding change in isoform abundance as a result of having iREMS elements in the presence of Compound 774 (at doses ranging from 0.3 µM to 3 µM), having statistically significant adjusted Fisher's Exact Test p value.

TABLE 7b

APLP2, AXIN1, CECR7, DAGLB, DLGAP4, ERCC1, ERGIC3,
FAM198B, GGCT, HAT1, HPS1, INPP5K, MADD, PPHLN1,
PRUNE2, RAP1A, RNFT1, RPS6KB2, SH3YL1, SKA2,
SPATA18, STRN3, TMEM189-UBE2V1, TRIM65, TUBE1,
UBE2V1, VPS29 or ZNF680

Methods of Preventing and/or Treating Diseases

In another aspect, provided herein are methods for preventing and/or treating a disease associated with the aberrant expression of a product of a gene (e.g., an mRNA transcript or protein), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In certain embodiments, the gene is any one of the genes disclosed in Tables 2-7 or 1. In certain embodiments, the gene contains a nucleotide sequence encoding a non-endogenous intronic REMS. In certain embodiments, the gene contains a nucleotide sequence encoding an endogenous intronic REMS. In one embodiment, provided herein are methods for preventing and/or treating a disease associated with aberrant expression of a product of a gene (e.g., an mRNA, RNA transcript or protein), by way of nonlimiting example, disclosed in Table 1, supra, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one of the introns comprises in 5' to 3' order: a branch point, a 3' splice site and an intronic REMS.

In another embodiment, provided herein are methods for preventing and/or treating a disease associated with aberrant expression of a product of a gene (e.g., an mRNA, RNA transcript or protein), disclosed in Tables 2-7, supra, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease associated with aberrant expression of a product of a gene (e.g., an mRNA, RNA transcript or protein), by way of nonlimiting example, disclosed in International Patent Application No. PCT/US2014/071252 (International Publication No. WO 2015/105657), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease associated with aberrant expression of a product of a gene (e.g., an mRNA, RNA transcript or protein), by way of nonlimiting example, disclosed in International Patent Application No. PCT/US2016/034864 (International Publication No. WO 2016/196386), wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease associated with aberrant expression of a product of a gene (e.g., an mRNA, RNA transcript or protein), by way of nonlimiting example, not disclosed in either International Publication No. WO 2015/105657, International Publication No. WO 2016/196386, or both, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease associated with aberrant expression of a product of a gene (e.g., an mRNA, RNA transcript or protein), disclosed in Table 1, supra, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease associated with aberrant expression of a product of a gene, disclosed in Table 7, supra, (e.g., an mRNA, RNA transcript or protein), comprising administering to a human or non-human subject a compound of Formula (I) or a form thereof, or a pharmaceutical composition comprising a compound of Formula (I) or a form thereof and a pharmaceutically acceptable carrier, excipient or diluent. See the example section for additional information regarding the genes in Table 7. In a specific embodiment, the gene comprises one or more introns, wherein at least one intron comprises in 5' to 3' order: a branch point, a 3' splice site and an intronic REMS.

In another aspect, provided herein are methods for preventing and/or treating a disease in which a change in the level of expression of one, two, three or more RNA isoforms encoded by a gene is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In certain embodiments, the gene is any one of the genes disclosed in Tables 2-7 or 1. In certain embodiments, the gene contains a nucleotide sequence encoding ae non-endogenous intronic REMS. In certain embodiments, the gene contains a nucleotide sequence encoding an endogenous intronic REMS. In one embodiment, provided herein are methods for preventing and/or treating a disease in which the alteration (e.g., increase or decrease) in the expression one, two, three or more RNA isoforms encoded by a gene, by way of nonlimiting example, disclosed in Table 1, supra, is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease in which the alteration (e.g., increase or decrease) in the expression one, two, three or more RNA isoforms encoded by a gene, disclosed in Tables 2-7, supra, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more RNA isoforms encoded by a gene, disclosed in International Patent Application No. PCT/US2014/071252 (International Publication No. WO 2015/105657), is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more RNA isoforms encoded by a gene, disclosed in International Patent Application No. PCT/US2016/034864 (International Publication No. WO 2016/196386), is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more RNA isoforms encoded by a gene, not disclosed in either International Publication No. WO 2015/105657, International Publication No. WO 2016/196386, or both, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease in which the alteration (e.g., increase or decrease) in the expression one, two, three or more RNA isoforms encoded by a gene, disclosed in Table 1, supra, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease in which the alteration (e.g., increase or decrease) in the expression one, two, three or more RNA isoforms encoded by a gene, disclosed in Table 1, supra, is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, one, two, three or more RNA isoforms encoded by a gene, disclosed in Table 7, supra, are decreased following administration of a compound of Formula (I) or a form thereof and a pharmaceutically acceptable carrier, excipient or diluent. See the example section for additional information regarding the genes in Table 7. In a specific embodiment, the gene comprises one or more introns, wherein at least one intron comprises in 5' to 3' order: a branch point, a 3' splice site and an intronic REMS.

In another aspect, provided herein are methods for preventing and/or treating a disease in which a change in the level of expression of one, two, three or more protein isoforms encoded by a gene is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In certain embodiments, the gene is any one of the genes disclosed in Tables 2-7 or 1. In certain embodiments, the gene contains a nucleotide sequence encoding a non-endogenous intronic REMS. In certain embodiments, the gene contains a nucleotide sequence encoding an endogenous intronic REMS. In one embodiment, provided herein are methods for preventing and/or treating a disease in which the alteration (e.g., increase or decrease) in the expression one, two, three or more protein isoforms encoded by a gene, by way of nonlimiting example, disclosed in Table 1, supra, is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease in which the alteration (e.g., increase or decrease) in the expression one, two, three or more protein isoforms encoded by a gene, disclosed in Tables 2-7, supra, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease in which the alteration (e.g., increase or decrease) in the expression one, two, three or more protein isoforms encoded by a gene, disclosed in International Patent Application No. PCT/US2014/071252 (International Publication No. WO 2015/105657), is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In another embodiment, provided herein are methods for preventing and/or treating a disease in which the alteration (e.g., increase or decrease) in the expression one, two, three or more protein isoforms encoded by a gene, disclosed in International Patent Application No. PCT/US2016/034864 (International Publication No. WO 2016/196386), is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease in which the alteration (e.g., increase or decrease) in the expression one, two, three or more protein isoforms encoded by a gene, disclosed in Table 1, supra, is beneficial to the prevention and/or treatment of the disease, wherein the precursor RNA transcript transcribed from the gene comprises an intronic REMS, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, the gene comprises one or more introns, wherein at least one intron comprises in 5' to 3' order: a branch point, a 3' splice site and an intronic REMS.

In another embodiment, provided herein are methods for preventing and/or treating a disease in which the alteration (e.g., increase or decrease) in the expression one, two, three or more protein isoforms encoded by a gene, disclosed in Table 1, supra, is beneficial to the prevention and/or treatment of the disease, the methods comprising administering to a human or non-human subject a compound of Formula (I) or a form thereof, or a pharmaceutical composition comprising a compound of Formula (I) or a form thereof and a pharmaceutically acceptable carrier, excipient or diluent. In a specific embodiment, one, two, three or more RNA isoforms encoded by a gene, disclosed in Table 7, supra, are decreased following administration of a compound of Formula (I) or a form thereof and a pharmaceutically acceptable carrier, excipient or diluent. See the example section for additional information regarding the genes in Table 7. In a specific embodiment, the gene comprises one or more introns, wherein at least one intron comprises in 5' to 3' order: a branch point, a 3' splice site and an intronic REMS.

In another embodiment, provided herein is a method for either preventing, treating or preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence encoding the intron comprises in 5' to 3' order: a nucleotide sequence encoding a first 5' splice site, a nucleotide sequence encoding a first branch point, a nucleotide sequence encoding a first 3' splice site, an iREMS, a nucleotide sequence encoding a second branch point and a nucleotide sequence encoding a second 3' splice site, wherein the iREMS comprises a DNA sequence GAgtrngn (SEQ ID NO: 4), and wherein r is adenine or guanine and n is any nucleotide, the method comprising administering a compound described herein (for example, a compound of Formula (I) or a form thereof) to the subject.

In another embodiment, provided herein is a method for either preventing, treating and preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the DNA nucleotide sequence of the intron comprises in 5' to 3' order: an iREMS, a nucleotide sequence encoding a first branch point and a nucleotide sequence encoding a first 3' splice site, wherein the iREMS comprises a DNA sequence GAgtrngn (SEQ ID NO: 4), and wherein r is adenine or guanine and n is any nucleotide, the method comprising administering a compound described herein (for example, a compound of Formula (I) or a form thereof) to the subject.

In another embodiment, provided herein is a method for either preventing, treating and preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence comprises exonic and intronic elements illustrated in FIG. 1A, the method comprising administering a compound described herein (for example, a compound of Formula (I) or a form thereof) to the subject.

In another embodiment, provided herein is a method for either preventing, treating or preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron, and wherein the DNA nucleotide sequence comprises exonic and intronic elements illustrated in FIG. 1B, the method comprising administering a compound described herein (for example, a compound of Formula (I) or a form thereof) to the subject.

In another embodiment, provided herein is a method for either preventing, treating or preventing and treating a disease in a subject in which the alteration (e.g., increase or decrease) in the expression one, two, three or more protein isoforms encoded by a gene is beneficial to the prevention and/or treatment of the disease, wherein the gene comprises a DNA nucleotide sequence encoding two exons and an intron and wherein the DNA nucleotide sequence comprises exonic and intronic elements illustrated in FIG. 1C, the method comprising administering a compound described herein (for example, a compound of Formula (I) or a form thereof) to the subject.

In a specific embodiment, the gene is a gene described in a table in this disclosure.

In some embodiments, the compound of Formula (I) or a form thereof that is administered to a subject is a compound of Formula (II), Formula (III), Formula (IV), Formula (V), Formula (VI), Formula (VII), Formula (VIII), Formula (IX), Formula (X), Formula (XI), Formula (XII), Formula (XIII), or Formula (XIV). In some embodiments, the compound of Formula (I) or a form thereof that is administered to a subject is a compound described herein.

In a specific embodiment, the methods for preventing a disease described herein prevent the onset or development of one or symptoms of the disease. In another embodiment, the methods for preventing a disease described herein prevent the recurrence of the disease or delays the recurrence of the disease. In another embodiment, the methods for treating a disease described herein has one, two or more of the effects: (i) reduce or ameliorate the severity of the disease; (ii) inhibit the progression of the disease; (iii) reduce hospitalization of a subject; (iv) reduce hospitalization length for a subject; (v) increase the survival of a subject; (vi) improve the quality of life of a subject; (vii) reduce the number of symptoms associated with the disease; (viii) reduce or ameliorates the severity of a symptom(s) associated with the disease; (ix) reduce the duration of a symptom(s) associated with the disease; (x) prevent the recurrence of a symptom associated with the disease; (xi) inhibit the development or onset of a symptom of the disease; and/or (xii) inhibit of the progression of a symptom associated with the disease.

In certain embodiments, the disease or disorder prevented and/or treated in accordance with a method described herein is a disease or disorder associated with a gene listed in Table 1 or Table 7. In specific embodiments, the disease or disorder prevented and/or treated in accordance with a method described herein is leukemia, acute myeloid leukemia, colon cancer, gastric cancer, macular degeneration, acute monocytic leukemia, breast cancer, combined methylmalonic aciduria and homocystinuria, cb1C type, hepatocellular carcinoma, cone-rod dystrophy, alveolar soft part sarcoma, myeloma, skin melanoma, prostatitis, pancreatitis, pancreatic cancer, retinitis, adenocarcinoma, adenoiditis, adenoid cystic carcinoma, cataract, retinal degeneration, gastrointestinal stromal tumor, Wegener's granulomatosis, sarcoma, myopathy, prostate adenocarcinoma, Alzheimer's disease, hyperprolinemia, acne, tuberculosis, succinic semialdehyde dehydrogenase deficiency, esophagitis, mental retardation, esophageal adenocarcinoma, glycine encephalopathy, Crohn's disease, spina bifida, tuberculosis, autosomal recessive disease, schizophrenia, neural tube defects, lung cancer, myelodysplastic syndromes, amyotropic lateral sclerosis, neuronitis, germ cell tumors, Parkinson's disease, talipes equinovarus, dystrophinopathies, Hodgkin's lymphoma, ovarian cancer, non-Hodgkin's lymphoma, multiple myeloma, chronic myeloid leukemia, ischemia, acute lymphoblastic leukemia, renal cell carcinoma, transitional cell carcinoma, colorectal cancer, chronic lymphocytic leukemia, anaplastic large cell lymphoma, kidney cancer, cerebritis, bladder related disorders, breast cancer, cervical cancer, cleft lip, cleft palate, cervicitis, spasticity, lipoma, scleroderma, Gitelman syndrome, poliomyelitis, paralysis, Aagenaes syndrome, or oculomotor nerve paralysis.

In specific embodiments, the disease or disorder prevented and/or treated in accordance with a method described herein is basal cell carcinoma, goblet cell metaplasia, or a malignant glioma. In other specific embodiments, the disease or disorder prevented and/or treated in accordance with a method described herein is a cancer of the liver, breast, lung, prostate, cervix, uterus, colon, pancreas, kidney, stomach, bladder, ovary, or brain.

In other specific embodiments, the disease or disorder prevented and/or treated in accordance with a method described herein is Duchenne muscular dystrophy, Beckers muscular dystrophy, Facioscapulohumeral muscular dystrophy, Limb-girdle muscular dystrophy, Charcot-Marie-Tooth disease (CMT), spinal muscular atrophy, Huntington's disease, amyotrophic lateral sclerosis, cystic fibrosis, congenital myopathies, muscle dystrophies, Alzheimer's disease, Parkinson's disease, schizophrenia, bipolar disorders, cognitive impairment, hereditary sensory and autonomic neuropathies, diseases of chronic inflammation, immune check point-dependent diseases, retinitis pigmentosa, aniridia, Dravet disease, or an epilepsy.

In certain embodiments, the disease prevented and/or treated in accordance with a method described herein is a disease caused by expression of one or more aberrant RNA transcripts, including a cancer amenable to treatment by downregulation of a gene or isoform thereof as described herein. In specific embodiments, cancers that can be prevented and/or treated in accordance with a method described herein include, but are not limited to, cancer of the head, neck, eye, mouth, throat, esophagus, esophagus, chest, bone, lung, kidney, colon, rectum or other gastrointestinal tract organs, stomach, spleen, skeletal muscle, subcutaneous tissue, prostate, breast, ovaries, testicles or other reproductive organs, skin, thyroid, blood, lymph nodes, kidney, liver, pancreas, brain or central nervous system.

Specific examples of cancers that can be prevented and/or treated in accordance with the methods provided herein include, but are not limited to, the following: renal cancer, kidney cancer, glioblastoma multiforme, metastatic breast cancer; breast carcinoma; breast sarcoma; neurofibroma; neurofibromatosis; pediatric tumors; neuroblastoma; malignant melanoma; carcinomas of the epidermis; leukemias such as but not limited to, acute leukemia, acute lymphocytic leukemia, acute myelocytic leukemias such as myeloblastic, promyelocytic, myelomonocytic, monocytic, erythroleukemia leukemias and myclodysplastic syndrome, chronic leukemias such as but not limited to, chronic myclocytic (granulocytic) leukemia, chronic lymphocytic leukemia, hairy cell leukemia; polycythemia vera; lymphomas such as but not limited to Hodgkin's disease, non-Hodgkin's disease; multiple myelomas such as but not limited to smoldering multiple myclomaa, nonsecretory myeloma, osteosclerotic myeloma, plasma cell leukemia, solitary plasmacytoma and extramedullary plasmacytoma; Waldenstrom's macroglobulinemia; monoclonal gammopathy of undetermined significance; benign monoclonal gammopathy; heavy chain disease; bone cancer and connective tissue sarcomas such as but not limited to bone sarcoma, myeloma bone disease, multiple myeloma, cholesteatoma-induced bone osteosarcoma, Paget's disease of bone, osteosarcoma, chondrosarcoma, Ewing's sarcoma, malignant giant cell tumor, fibrosarcoma of bone, chordoma, periosteal sarcoma, soft-tissue sarcomas, angiosarcoma (hemangiosarcoma), fibrosarcoma, Kaposi's sarcoma, leiomyosarcoma, liposarcoma, lymphangiosarcoma, neurilemmoma, rhabdomyosarcoma, and synovial sarcoma; brain tumors such as but not limited to, glioma, astrocytoma, brain stem glioma, ependymoma, oligodendroglioma, nonglial tumor, acoustic neurinoma, craniopharyngioma, medulloblastoma, meningioma, pineocytoma, pineoblastoma, and primary brain lymphoma; breast cancer including but not limited to adenocarcinoma, lobular (small cell) carcinoma, intraductal carcinoma, medullary breast cancer, mucinous breast cancer, tubular breast cancer, papillary breast cancer, Paget's disease (including juvenile Paget's disease) and inflammatory breast cancer; adrenal cancer such as but not limited to pheochromocytom and adrenocortical carcinoma; thyroid cancer such as but not limited to papillary or follicular thyroid cancer, medullary thyroid cancer and anaplastic thyroid cancer; pancreatic cancer such as but not limited to, insulinoma, gastrinoma, glucagonoma, vipoma, somatostatin-secreting tumor, and carcinoid or islet cell tumor; pituitary cancers such as but limited to Cushing's disease, prolactin-secreting tumor, acromegaly, and diabetes insipius; eye cancers such as but not limited to ocular melanoma such as iris melanoma, choroidal melanoma, and cilliary body melanoma, and retinoblastoma; vaginal cancers such as squamous cell carcinoma, adenocarcinoma, and melanoma; vulvar cancer such as squamous cell carcinoma, melanoma, adenocarcinoma, basal cell carcinoma, sarcoma, and Paget's disease; cervical cancers such as but not limited to, squamous cell carcinoma, and adenocarcinoma; uterine cancers such as but not limited to endometrial carcinoma and uterine sarcoma; ovarian cancers such as but not limited to, ovarian epithelial carcinoma, borderline tumor, germ cell tumor, and stromal tumor; cervical carcinoma; esophageal cancers such as but not limited to, squamous cancer, adenocarcinoma, adenoid cyctic carcinoma, mucoepidermoid carcinoma, adenosquamous carcinoma, sarcoma, melanoma, plasmacytoma, verrucous carcinoma, and oat cell (small cell) carcinoma; stomach cancers such as but not limited to, adenocarcinoma, fungating (polypoid), ulcerating, superficial spreading, diffusely spreading, malignant lymphoma, liposarcoma, fibrosarcoma, and carcinosarcoma; colon cancers; KRAS-mutated colorectal cancer; PD-1-dependent cancers; PD-1L-dependent cancers; colon carcinoma; rectal cancers; liver cancers such as but not limited to hepatocellular carcinoma and hepatoblastoma, gallbladder cancers such as adenocarcinoma; cholangiocarcinomas such as but not limited to papillary, nodular, and diffuse; lung cancers such as KRAS-mutated non-small cell lung cancer, non-small cell lung cancer, squamous cell carcinoma (epidermoid carcinoma), adenocarcinoma, large-cell carcinoma and small-cell lung cancer; lung carcinoma; testicular cancers such as but not limited to germinal tumor, seminoma, anaplastic, classic (typical), spermatocytic, nonseminoma, embryonal carcinoma, teratoma carcinoma, choriocarcinoma (yolk-sac tumor), prostate cancers such as but not limited to, androgen-independent prostate cancer, androgen-dependent prostate cancer, adenocarcinoma, leiomyosarcoma, and rhabdomyosarcoma; penal cancers; oral cancers such as but not limited to squamous cell carcinoma; basal cancers; salivary gland cancers such as but not limited to adenocarcinoma, mucoepidermoid carcinoma, and adenoidcystic carcinoma; pharynx cancers such as but not limited to squamous cell cancer, and verrucous; skin cancers such as but not limited to, basal cell carcinoma, squamous cell carcinoma and melanoma, superficial spreading melanoma, nodular melanoma, lentigo malignant melanoma, acral lentiginous melanoma; kidney cancers such as but not limited to renal cell cancer, adenocarcinoma, hypernephroma, fibrosarcoma, transitional cell cancer (renal pelvis and/or uterer); renal carcinoma; Wilms' tumor; bladder cancers such as but not limited to transitional cell carcinoma, squamous cell cancer, adenocarcinoma, carcinosarcoma. In addition, cancers include myxosarcoma, osteogenic sarcoma, endotheliosarcoma, lymphangioendotheliosarcoma, mesothelioma, synovioma, hemangioblastoma, epithelial carcinoma, cystadenocarcinoma, bronchogenic carcinoma, sweat gland carcinoma, sebaceous gland carcinoma, papillary carcinoma and papillary adenocarcinomas.

In certain embodiments cancers that can be prevented and/or treated in accordance with the methods provided herein include, the following: pediatric solid tumor, Ewing's sarcoma, Wilms tumor, neuroblastoma, neurofibroma, carcinoma of the epidermis, malignant melanoma, cervical carcinoma, colon carcinoma, lung carcinoma, renal carcinoma, breast carcinoma, breast sarcoma, metastatic breast cancer, HIV-related Kaposi's sarcoma, prostate cancer, androgen-independent prostate cancer, androgen-dependent prostate cancer, neurofibromatosis, lung cancer, non-small cell lung cancer, KRAS-mutated non-small cell lung cancer, malignant melanoma, melanoma, colon cancer, KRAS-mutated colorectal cancer, glioblastoma multiforme, renal cancer, kidney cancer, bladder cancer, ovarian cancer, hepatocellular carcinoma, thyroid carcinoma, rhabdomyosarcoma, acute myeloid leukemia, and multiple myeloma.

In certain embodiments, cancers and conditions associated therewith that are prevented and/or treated in accordance with the methods provided herein are breast carcinomas, lung carcinomas, gastric carcinomas, esophageal carcinomas, colorectal carcinomas, liver carcinomas, ovarian carcinomas, thecomas, arrhenoblastomas, cervical carcinomas, endometrial carcinoma, endometrial hyperplasia, endometriosis, fibrosarcomas, choriocarcinoma, head and neck cancer, nasopharyngeal carcinoma, laryngeal carcinomas, hepatoblastoma, Kaposi's sarcoma, melanoma, skin carcinomas, hemangioma, cavernous hemangioma, hemangioblastoma, pancreas carcinomas, retinoblastoma, astrocytoma, glioblastoma, Schwannoma, oligodendroglioma, medulloblastoma, neuroblastomas, rhabdomyosarcoma, osteogenic sarcoma, leiomyosarcomas, urinary tract carcinomas, thyroid carcinomas, Wilm's tumor, renal cell carcinoma, prostate carcinoma, abnormal vascular proliferation associated with phakomatoses, edema (such as that associated with brain tumors), or Meigs' syndrome. In specific embodiment, the cancer astrocytoma, an oligodendroglioma, a mixture of oligodendroglioma and an astrocytoma elements, an ependymoma, a meningioma, a pituitary adenoma, a primitive neuroectodermal tumor, a medullblastoma, a primary central nervous system (CNS) lymphoma, or a CNS germ cell tumor. In specific embodiments, the cancer treated in accordance with the methods provided herein is an acoustic neuroma, an anaplastic astrocytoma, a glioblastoma multiforme, or a meningioma. In other specific embodiments, the cancer treated in accordance with the methods provided herein is a brain stem glioma, a craniopharyngioma, an ependyoma, a juvenile pilocytic astrocytoma, a medulloblastoma, an optic nerve glioma, primitive neuroectodermal tumor, or a rhabdoid tumor.

Specific examples of conditions caused by expression of one or more aberrant RNA transcripts that can be prevented and/or treated in accordance with the methods described herein include cystic fibrosis, muscular dystrophy, polycystic autosomal-dominant kidney disease, cancer-induced cachexia, benign prostatic hyperplasia, rheumatoid arthritis, psoriasis, atherosclerosis, obesity, retinopathies (including diabetic retinopathy and retinopathy of prematurity), retrolental fibroplasia, neovascular glaucoma, age-related macular degeneration, exudative macular degeneration, thyroid hyperplasias (including Grave's disease), corneal and other tissue transplantation, epidemic keratoconjunctivitis, Vitamin A deficiency, contact lens overwear, atopic keratitis, superior limbic keratitis, and pterygium keratitis sicca, viral infections, inflammation associated with viral infections, chronic inflammation, lung inflammation, nephrotic syndrome, preeclampsia, ascites, pericardial effusion (such as that associated with pericarditis), pleural effusion, Sjogren's syndrome, acne rosacea, phylectenulosis, syphilis, lipid degeneration, chemical burns, bacterial ulcers, fungal ulcers, Herpes simplex infection, Herpes zoster infections, protozoan infections, Mooren's ulcer, Terrien's marginal degeneration, marginal keratolysis, systemic lupus, polyarteritis, trauma, Wegener's sarcoidosis, Paget's disease, scleritis, Stevens-Johnson's disease, pemphigoid, radial keratotomy, Eales' disease, Behcet's disease, sickle cell anemia, pseudoxanthoma elasticum, Stargardt's disease, pars planitis, chronic retinal detachment, vein occlusion, artery occlusion, carotid obstructive disease, chronic uveitis/vitritis, ocular histoplasmosis, Mycobacteria infections, Lyme's disease, Best's disease, myopia, optic pits, hyperviscosity syndromes, toxoplasmosis, sarcoidosis, trauma, post-laser complications, diseases associated with rubeosis (neovascularization of the iris and of the angle), and diseases caused by the abnormal proliferation of fibrovascular or fibrous tissue, including all forms of prolific vitreoretinopathy. Certain examples of non-neoplastic conditions that can be prevented and/or treated in accordance with the methods described herein include viral infections, including but not limited to, those associated with viruses belonging to Flaviviridae, flavivirus, pestivirus, hepacivirus, West Nile virus, hepatitis C virus (HCV) or human papilloma virus (HPV).

Particular examples of conditions caused by expression of one or more of aberrant RNA transcripts that can be prevented and/or treated in accordance with the methods described herein include Duchenne muscular dystrophy, Beckers muscular dystrophy, Facioscapulohumeral muscular dystrophy, Limb-girdle muscular dystrophy, Charcot-Marie-Tooth disease (CMT), spinal muscular atrophy, Huntington's disease, amyotrophic lateral sclerosis, cystic fibrosis, congenital myopathies, muscle dystrophies, Alzheimer's disease, Parkinson's disease, schizophrenia, bipolar disorders, cognitive impairment, hereditary sensory and autonomic neuropathies, diseases of chronic inflammation, immune check point-dependent diseases, retinitis pigmentosa, aniridia, Dravet disease, or an epilepsy.

Artificial Gene Constructs

Also provided herein are artificial gene constructs comprising a DNA sequence encoding exons and one or more introns, wherein the nucleotide sequence of at least one intron encodes an intronic REMS downstream of the nucleotide sequence encoding a branch point and the nucleotide sequence encoding a 3' splice site in 5' to 3' order, and artificial gene constructs comprising an RNA sequence that comprises exons and one or more introns, wherein at least one intron comprises a branch point, a 3' splice site and an intronic REMS in 5' to 3' order. The DNA sequence described herein can be or derived from, for example, a genomic DNA sequence or a DNA analog thereof. The RNA sequence described herein can be or derived from, for example, a precursor RNA transcript or an RNA analog thereof. As used herein, the term "artificial gene construct" refers to a DNA or RNA gene construct that comprises a nucleotide sequence not found in nature.

In another aspect, provided herein is an artificial gene construct comprising an RNA sequence comprising two exons and an intron, wherein one exon is upstream of the intron and the other exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn (SEQ ID NO: 2), and wherein r is adenine or guanine and n is any nucleotide.

In another aspect, provide herein is an artificial gene construct comprising an RNA sequence comprising two exons and an intron, wherein one exon is upstream of the intron and the other exon is downstream of the intron, wherein the RNA nucleotide sequence of the intron comprises in 5' to 3' order: an iREMS, a first branch point and a first 3' splice site, wherein the iREMS comprises an RNA sequence GAgurngn (SEQ ID NO: 2), and wherein r is adenine or guanine and n is any nucleotide.

In another aspect, provided herein is an artificial gene construct comprising an RNA sequence comprising two exons and an intron, wherein the RNA sequence comprises exonic and intronic elements illustrated in FIG. 1A.

In another aspect, provided herein is an artificial gene construct comprising an RNA sequence comprising two exons and an intron, wherein the RNA sequence comprises exonic and intronic elements illustrated in FIG. 1B.

In another aspect, provided herein is an artificial gene construct comprising an RNA sequence comprising two exons and an intron, wherein the RNA sequence comprises exonic and intronic elements illustrated in FIG. 1C.

In another aspect, provided herein is an artificial gene construct comprising a DNA sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the nucleotide sequence encoding the intron comprises in 5' to 3' order: a nucleotide sequence encoding a first 5' splice site, a nucleotide sequence encoding a first branch point, a nucleotide sequence encoding a first 3' splice site, an iREMS, a nucleotide sequence encoding a second branch point and a nucleotide sequence encoding a second 3' splice site, wherein the iREMS comprises a DNA sequence GAgtrngn (SEQ ID NO: 4), and wherein r is adenine or guanine and n is any nucleotide.

In another aspect, provide herein is an artificial gene construct comprising a DNA sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the nucleotide sequence encoding the intron comprises in 5' to 3' order: an iREMS, a nucleotide sequence encoding a first branch point and a nucleotide sequence encoding a first 3' splice site, wherein the iREMS comprises an DNA sequence GAgtrngn (SEQ ID NO: 4), wherein r is adenine or guanine and n is any nucleotide.

In another aspect, provide herein is an artificial gene construct comprising a DNA sequence encoding two exons and an intron, wherein the DNA sequence comprises exonic and intronic elements illustrated in FIG. 1A.

In another aspect, provide herein is an artificial gene construct comprising a DNA sequence encoding two exons and an intron, wherein the DNA sequence comprises exonic and intronic elements illustrated in FIG. 1B.

In another aspect, provide herein is an artificial gene construct comprising a DNA sequence encoding two exons and an intron, wherein the DNA sequence comprises exonic and intronic elements illustrated in FIG. 1C.

In one aspect, provided herein are artificial gene constructs comprising an intronic REMS. In one embodiment, an artificial gene construct comprises genomic DNA or DNA encoding exons and one, two or more introns, wherein a nucleotide sequence encoding an intronic REMS, which may be upstream or downstream of a nucleotide sequence encoding a branch point and a nucleotide sequence encoding a 3' splice site, is modified to introduce a nucleotide sequence encoding the intronic REMS. In another embodiment, an artificial gene construct comprises DNA encoding exons, an intronic REMS, a 3' splice site(s) and a branch point(s) sequence, wherein a nucleotide sequence encoding an intronic REMS, which may be upstream or downstream of at least one nucleotide sequence encoding a branch point and at least one nucleotide sequence encoding a 3' splice site, is modified to introduce a nucleotide sequence encoding an intronic REMS. In another embodiment, an artificial gene construct comprises genomic DNA or DNA encoding exons and one, two or more introns, wherein a nucleotide sequence encoding an intronic REMS, which may be upstream or downstream of a nucleotide sequence encoding a branch point and a nucleotide sequence encoding a 3' splice site, is introduced into an intron by genetic engineering. In another embodiment, an artificial gene construct comprises genomic DNA or DNA encoding exons and one, two or more introns, wherein a nucleotide sequence encoding an intronic REMS, which may be upstream or downstream of a nucleotide sequence encoding a branch point and a nucleotide sequence encoding a 3' splice site, is endogenously present in an intron. In some embodiments, an artificial gene construct comprises a DNA sequence that is genetically engineered to introduce a nucleotide sequence encoding an intronic REMS, wherein the location of the intronic REMS is as illustrated in any of FIGS. 1A-1C. In some embodiments, an artificial gene construct comprises a DNA sequence that is genetically engineered to comprise one, two, or all of the following: intronic REMS, branch point, and 3' splice site. In some embodiments, an artificial gene construct comprises a DNA sequence that is genetically engineered to comprise a branch point, a 3' splice site and an intronic REMS, in 5' to 3' order. In certain embodiments, the DNA sequence chosen to be used in the production of an artificial gene construct may contain a nucleotide sequence encoding an intronic REMS and an additional nucleotide sequence encoding an intronic REMS or a branch point or a 3' splice site sequence is introduced. In specific embodiments, the nucleotide sequence encoding an intronic REMS or a branch point or a 3' splice site is a non-endogenous sequence, i.e., a sequence not naturally found in the DNA sequence of the artificial gene construct. In certain embodiments, the artificial gene construct comprises other elements, such as a promoter (e.g., a constitutive, inducible or tissue specific promoter), a Poly(A) site, a transcription termination site, and a transcription binding site(s). In certain embodiments, the artificial gene construct comprises at least the sequences to encode a therapeutic protein. In some embodiments, the artificial gene construct comprises at least an intronic REMS for a gene listed in Table 1-7. In a specific embodiment, the artificial gene construct further comprises exons of a gene listed in Table 1-7. In certain embodiments, the artificial gene construct comprises at least the exons of a detectable reporter gene, such as green fluorescent protein (GFP), yellow fluorescent protein (YFP), red fluorescent protein, beta galactosidase, renilla luciferase, firefly luciferase, etc.

In certain embodiments, an artificial gene construct is produced as follows: a nucleotide sequence encoding an intronic REMS is introduced into a nucleotide sequence encoding an existing intronic branch point and intronic 3' splice site of genomic DNA or DNA, wherein the DNA encodes two or more exons and one or more introns, and wherein the nucleotide sequence encoding the intronic REMS is downstream (in a preferred embodiment) or upstream of a nucleotide sequence encoding a branch point and a 3' splice site. In some embodiments, an artificial gene construct is produced as follows: a nucleotide sequence encoding an intronic REMS is introduced downstream (in a preferred embodiment) or upstream of a nucleotide sequence encoding a branch point and a 3' splice site of genomic DNA or DNA, wherein the DNA encodes two or more exons and an intron(s). In a specific embodiment, the nucleotide sequence encoding the intronic REMS is introduced internally within a nucleotide sequence encoding an intron. In certain embodiments, an artificial gene construct is produced as follows: a nucleotide sequence encoding an intronic REMS, a nucleotide sequence encoding a branch point, and a nucleotide sequence encoding a 3' splice site are introduced into a cDNA, wherein the nucleotide sequence encoding the intronic REMS may be upstream of the branch point and 3' splice site, respectively; or may be downstream (in a preferred embodiment) of the 3' splice site and branch point, respectively. The nucleotide sequence encoding the intronic REMS functions as a 5' splice site. In certain embodiments, the nucleotide sequence encoding the intronic REMS is internally within an intron. In a specific embodiment, the genomic DNA or DNA chosen for use in the production of an artificial gene construct does not contain one or more of a nucleotide sequence encoding an intronic REMS or a nucleotide sequence encoding a branch point or a nucleotide sequence encoding a 3' splice site. In certain embodiments, the genomic DNA or DNA chosen for use in the production of an artificial gene construct contains an intronic REMS and an additional intronic REMS is introduced. In some embodiments, in introducing a nucleotide sequence encoding an intronic REMS into a DNA sequence, care should be taken so as not to disrupt an open reading frame or introduce a stop codon. The introduction of a nucleotide sequence encoding an intronic REMS into a DNA sequence may or may not result in an amino acid change at the protein level. In certain embodiments, the introduction of a nucleotide sequence encoding an intronic REMS into a DNA sequence results in an amino acid change at the protein level. In some embodiments, this amino acid change is a conservative amino acid substitution. In other embodiments, the introduction of a nucleotide sequence encoding an intronic REMS into a DNA sequence does not result in an amino acid change at the protein level. Techniques known to one of skill in the art may be used to introduce an intronic REMS and other elements, such as a branch point sequence or 3' splice site sequence into a DNA sequence, e.g., gene editing techniques such as the CRISPR-Cas approach, Transcription Activator-Like Effector Nucleases (TALENs), or Zinc finger nucleases (ZFNs) may be used.

In certain embodiments, an artificial gene construct comprises an RNA sequence comprising exons and one, two or more introns, wherein an intronic REMS 5' splice site, which is downstream of a 3' splice site, is introduced into an intron by genetic engineering. In another embodiment, an artificial gene construct comprises an RNA sequence comprising exons, one, two or more introns, a 5' splice site(s), a 3' splice site(s) and a branch point(s), wherein an intronic REMS, which is downstream of a 3' splice site, is introduced into an intron by genetic engineering. In some embodiments, an artificial gene construct comprises a DNA sequence that is genetically engineered to comprise one, two, or all of the following: branch point, 3' splice site and/or intronic REMS. In some embodiments, an artificial gene construct comprises a DNA sequence that is genetically engineered to comprise a branch point, a 3' splice site and an intronic REMS, in 5' to 3' order. In another embodiment, an artificial gene construct comprises an RNA sequence comprising exons and one or more introns, wherein at least one intron comprises in 5' to 3' order: a branch point, a 3' splice site and an intronic REMS, wherein the intronic REMS is endogenously present in an intron. In another embodiment, an artificial gene construct comprises an RNA sequence comprising exons, endogenously having a 5' splice site(s), a 3' splice site(s) and a branch point(s), wherein an intron, which is upstream of a 3' splice site, is modified to introduce a non-endogenous branch point, a non-endogenous 3' splice site and a non-endogenous intronic REMS. In specific embodiments, the intronic REMS is non-endogenous, i.e., not naturally found in the RNA sequence of the artificial gene construct. In certain embodiments, the artificial gene construct comprises other elements, such as a promoter (e.g., a tissue-specific promoter or constitutively expressed promoter), 5' untranslated region, 3' untranslated region, a binding site(s) for RNA binding proteins, a small molecule RNA sensor(s), e.g., riboswitches, stem-loop structures, and/or internal ribosome entry sites (IRES), etc. In certain embodiments, the artificial gene construct comprises at least the introns of a gene encoding a therapeutic protein. In some embodiments, the artificial gene construct comprises at least the introns of a gene listed in Tables 1-7. In a specific embodiment, the artificial gene construct further comprises exons of a gene listed in Table 1-7. In a specific embodiment, the RNA transcript chosen to be used in the production of an artificial gene construct does not contain an intronic REMS. In certain embodiments, the RNA transcript chosen to use in the production of an artificial gene construct contains an intronic REMS and an additional exonic or intronic REMS is introduced. In certain embodiments, the RNA transcript chosen to use in the production of an artificial gene construct contains an intronic REMS and an additional intronic REMS is introduced. In other embodiments, the artificial gene construct comprises at least one intron and two exons of a detectable reporter gene, such as green fluorescent protein (GFP), yellow fluorescent protein (YFP), red fluorescent protein, beta galactosidase, renilla luciferase, firefly luciferase, etc.

In certain embodiments, an artificial gene construct is produced as follows: an intronic REMS is introduced into an existing 5' splice site of precursor RNA, wherein the RNA comprises two or more exons and one or more introns, and wherein an intronic REMS is upstream of a branch point sequence and a 3' splice site sequence. In some embodiments, an artificial gene construct is produced as follows: an intronic REMS is introduced upstream of a 3' splice site of a precursor RNA, wherein the RNA comprises two or more exons and an intron(s). In a specific embodiment, the intronic REMS is introduced internally within an intron. In certain embodiments, an artificial gene construct is produced as follows: a branch point, a 3' splice site and an intronic REMS are introduced into a precursor RNA, wherein the REMS may be either downstream or upstream of the branch point and 3' splice site. In certain embodiments, an artificial gene construct is produced as follows: a branch point, a 3' splice site and an intronic REMS are introduced into an mRNA, wherein the REMS may be either downstream or upstream of the branch point and 3' splice site. The intronic REMS functions as a 5' splice site. In some embodiments, in introducing an intronic REMS into an RNA sequence, care should be taken so as not to disrupt an open reading frame or introduce a stop codon. The introduction of an intronic REMS into an RNA transcript may or may not result in an amino acid change at the protein level. In certain embodiments, the introduction of an intronic REMS into an RNA transcript results in an amino acid change at the protein level. In some embodiments, this amino acid change is a conservative amino acid substitution. In other embodiments, the introduction of an intronic REMS into an RNA transcript does not result in an amino acid change at the protein level. Techniques known to one of skill in the art may be used to introduce an intronic REMS and other elements, such as a branch point or 3' splice site into an RNA transcript.

In some embodiments, an artificial gene construct is present in a viral vector (e.g., an adeno-associated virus (AAV), self-complimentary adeno-associated virus, adenovirus, retrovirus, lentivirus (e.g., Simian immunodeficiency virus, human immunodeficiency virus, or modified human immunodeficiency virus), Newcastle disease virus (NDV), herpes virus (e.g., herpes simplex virus), alphavirus, vaccina virus, etc.), a plasmid, or other vector (e.g., non-viral vectors, such as lipoplexes, liposomes, polymerosomes, or nanoparticles).

In some embodiments, the artificial gene construct is an RNA molecule modified to enable cellular uptake. In certain embodiments, the artificial gene construct is an RNA molecule containing pseudouridine or other modified/artificial nucleotides for enhanced cellular uptake and gene expression.

The use of an artificial gene construct described herein in gene therapy allows one to regulate the amount and type of a protein produced from the construct depending on whether or not a compound described herein is present. The compound is essentially a tunable switch that, depending on the amount and duration of the dose of the compound, regulates the amount and type of protein produced.

In certain embodiments, an RNA transcript transcribed from an artificial gene construct that is DNA would not produce or produce substantially less functional protein in the presence of a compound described herein than the amount of functional protein produced in the absence of a compound described herein. For example, if the artificial gene construct comprises a nucleotide sequence encoding an intronic REMS, which is downstream of an intronic nucleotide sequence encoding a branch point and a 3' splice site, then the creation of an intronic exon would ultimately result in less amount of the original protein (i.e., without amino acid sequence derived from the intronic exon) being produced in the presence of a compound described herein. Alternatively, in certain embodiments, an RNA transcript transcribed from an artificial gene construct that is DNA would produce or would produce substantially less functional protein in the presence of a compound described herein than the amount of functional protein produced in the absence of a compound described herein.

In certain embodiments, an artificial gene construct or vector comprising an artificial gene construct is used in cell culture. For example, in a cell(s) transfected with an artificial gene construct or transduced with a vector comprising an artificial gene construct, the amount and type of a protein produced from the artificial gene construct can be altered depending upon whether or not a compound described herein is contacted with the transfected cell(s). For example, if the artificial gene construct comprises a nucleotide sequence encoding an intronic REMS, which is downstream of a nucleotide sequence encoding a branch point and a 3' splice site, then the likelihood of producing an intronic exon would be less in the absence of the compound. Thus, the use of an artificial gene construct described herein allows one to regulate the amount and type of a protein produced from the construct depending on whether or not a compound described herein is present. In other words, a compound described herein is essentially a switch that regulates the amount and type of protein produced. This regulation of the production of protein could be useful, e.g., when trying to assess the role of certain genes or the effects of certain agents on pathways. The amount of the protein produced can be modified based on the amount of a compound described herein that is contacted with the transfected cell and/or how long the compound is contacted with the transfected cell.

In certain embodiments, an animal (e.g., a non-human animal, such as a mouse, rat, fly, etc.) is engineered to contain an artificial gene construct or a vector comprising an artificial gene construct. Techniques known to one of skill in the art may be used to engineer such animals. The amount of protein produced by this engineered animal can be regulated by whether or not a compound described herein is administered to the animal. The amount of the protein produced can be titrated based on the dose and/or the duration of administration of a compound described herein to the engineered animal. In certain embodiments, the artificial gene construct encodes a detectable reporter gene, such as green fluorescent protein (GFP), yellow fluorescent protein (YFP), red fluorescent protein, beta galactosidase, renilla luciferase, firefly luciferase, etc. In accordance with this embodiment, the engineered animal may be used to monitor development at different stages, visualize tissue function, etc. In other embodiments, the artificial gene construct encodes a therapeutic gene product, such as described the gene product of a gene in Tables 2-7 and 1. In accordance with this embodiment, the engineered animal may be used to monitor development at different stages or in functional biological studies where a certain protein or protein isoform needs to be expressed only for a period of time and not constitutively, etc.

In certain embodiments, an artificial gene construct or a vector comprising an artificial gene construct are used in gene therapy. Non-limiting examples of vectors include, but are not limited to, plasmids and viral vectors, such as vectors derived from replication defective retroviruses, adenoviruses, adeno-associated viruses and baculoviruses. The vector can be an RNA vector or preferably a DNA vector.

Gene Therapy

In another aspect, provided herein are artificial gene constructs or vectors comprising an artificial gene construct for use in gene therapy. The use of an artificial gene construct described herein in gene therapy allows one to regulate the amount and type of a protein produced from the construct depending on whether or not a compound described herein is present. The compound is essentially a switch that regulates the amount and type of protein produced.

In certain embodiments, an RNA transcript transcribed from an artificial gene construct that is DNA would not produce or would produce substantially more protein in the absence of a compound described herein than the amount of protein produced in the presence of a compound described herein. In certain embodiments, an RNA transcript transcribed from an artificial gene construct would not produce or would produce substantially more protein in the absence of a compound described herein than the amount of protein produced in the presence of a compound described herein. For example, if the artificial gene construct comprises a nucleotide sequence encoding an intronic REMS, which is downstream of a nucleotide sequence encoding a branch point and a 3' splice site, then the likelihood of producing an intronic exon would be less in the absence of a compound described herein, which would ultimately result in more amount of the original protein (i.e., without amino acid sequence derived from the intronic exon) being produced. Thus, the use of an artificial gene construct or a vector comprising an artificial gene construct may be useful in treating and/or preventing certain conditions or diseases associated with genes. The conditions or diseases may include those described herein. Alternatively, in certain embodiments, an RNA transcript transcribed from an artificial gene construct that is DNA would produce substantially less functional protein in the presence of a compound described herein than the amount of functional protein produced in the absence of a compound described herein. For example, in certain embodiments, if the artificial gene construct comprises a nucleotide sequence encoding an intronic REMS, the production of the original protein (i.e., without amino acid sequence derived from the intronic exon), which is a functional protein, would be reduced in the presence of a compound described herein. However, in the absence of a compound described herein, normal splicing would occur, and the production of the functional protein will not be reduced. The amount and type of the protein produced can be titrated based on dose and duration of dosing of the compound.

In a specific embodiment, the artificial gene construct used in gene therapy comprises an RNA sequence comprising two exons and an intron, wherein one exon is upstream of the intron and the other exon is downstream of the intron, wherein the RNA nucleotide sequence of the intron comprises in 5' to 3' order: a first 5' splice site, a first branch point, a first 3' splice site, an iREMS, a second branch point and a second 3' splice site, wherein the iREMS comprises an RNA sequence GAgurngn (SEQ ID NO: 2), and wherein r is adenine or guanine and n is any nucleotide.

In another specific embodiment, the artificial gene construct used in gene therapy comprises an RNA sequence comprising two exons and an intron, wherein one exon is upstream of the intron and the other exon is downstream of the intron, wherein the RNA nucleotide sequence of the intron comprises in 5' to 3' order: an iREMS, a first branch point and a first 3' splice site, wherein the iREMS comprises an RNA sequence GAgurngn (SEQ ID NO: 2), and wherein r is adenine or guanine and n is any nucleotide.

In another specific embodiment, the artificial gene construct used in gene therapy comprises an RNA sequence comprising two exons and an intron, wherein the RNA sequence comprises exonic and intronic elements illustrated in FIG. 1A.

In another specific embodiment, the artificial gene construct used in gene therapy comprises an RNA sequence comprising two exons and an intron, wherein the RNA sequence comprises exonic and intronic elements illustrated in FIG. 1B.

In another specific embodiment, the artificial gene construct used in gene therapy comprises an RNA sequence comprising two exons and an intron, wherein the RNA sequence comprises exonic and intronic elements illustrated in FIG. 1C.

In another specific embodiment, the artificial gene construct used in gene therapy comprises a DNA sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the nucleotide sequence encoding the intron comprises in 5' to 3' order: a nucleotide sequence encoding a first 5' splice site, a nucleotide sequence encoding a first branch point, a nucleotide sequence encoding a first 3' splice site, an iREMS, a nucleotide sequence encoding a second branch point and a nucleotide sequence encoding a second 3' splice site, wherein the iREMS comprises a DNA sequence GAgtrngn (SEQ ID NO: 4), wherein r is adenine or guanine and n is any nucleotide.

In another specific embodiment, the artificial gene construct used in gene therapy comprises a DNA sequence encoding two exons and an intron, wherein the nucleotide sequence encoding one exon is upstream of the nucleotide sequence encoding the intron and the nucleotide sequence encoding the other exon is downstream of the nucleotide sequence encoding the intron, wherein the nucleotide sequence encoding the intron comprises in 5' to 3' order: an iREMS, a nucleotide sequence encoding a first branch point and a nucleotide sequence encoding a first 3' splice site, wherein the iREMS comprises an DNA sequence GAgtrngn (SEQ ID NO: 4), wherein r is adenine or guanine and n is any nucleotide.

In another specific embodiment, the artificial gene construct used in gene therapy comprises a DNA sequence encoding two exons and an intron, wherein the DNA sequence comprises exonic and intronic elements illustrated in FIG. 1A.

In another specific embodiment, the artificial gene construct used in gene therapy comprises a DNA sequence encoding two exons and an intron, wherein the DNA sequence comprises exonic and intronic elements illustrated in FIG. 1B.

In another specific embodiment, the artificial gene construct used in gene therapy comprises a DNA sequence encoding two exons and an intron, wherein the DNA sequence comprises exonic and intronic elements illustrated in FIG. 1C.

An artificial gene construct, a vector comprising the artificial gene construct, or an RNA molecule comprising an artificial gene construct modified to enable cellular uptake may be introduced into cells or administered directly to patients. In one embodiment, an artificial gene construct or a vector comprising the artificial gene construct is introduced into cells ex vivo or in vivo. In a specific embodiment, an artificial gene construct or vector is introduced into a cell(s) ex vivo and the cell(s) may be administered to a subject. Various techniques known to one of skill in the art may be used to introduce an artificial gene construct or vector comprising the artificial gene construct into a cell(s), such as electroporation, transfection, transformation, etc. In another embodiment, an artificial gene construct or vector comprising the artificial gene construct is administered to a subject. The artificial gene construct or vector comprising the artificial gene construct may be administered to a subject by any technique known to one skilled in the art, e.g., intramuscularly, intravenously, subcutaneously, intradermally, topically, intrathecally, intraperitoneally, intratumorally, etc. In some embodiments, the artificial gene construct or vector comprising the artificial gene construct is administered to a subject systemically. In other embodiments, the artificial gene construct or vector comprising the artificial gene construct is administered to a subject locally.

Altering Endogenous Genes

In another aspect, provided herein are method for altering an endogenous gene such that it contains a nucleotide sequence encoding an intronic REMS, or contains an additional nucleotide sequence encoding an intronic REMS (in other words, an intronic REMS not naturally found in the endogenous gene, i.e., a non-endogenous intronic REMS). In a specific embodiment, provided herein are method for altering an endogenous gene such that it contains a nucleotide sequence encoding an intronic REMS and contains a nucleotide sequence encoding a branch point and a nucleotide sequence encoding a 3' splice site upstream of the nucleotide sequence encoding the intronic REMS. As used herein, the term "endogenous gene" refers to a gene naturally found in a cell or living subject. Techniques known to one of skill in the art can be used to introduce any one, two, or all of the following: a branch point, a 3' splice site, and an intronic REMS into an endogenous gene, e.g., the CRISPR-Cas approach, TALEN, or ZFN may be used. In certain embodiments, a nucleotide sequence encoding an existing 5' splice site can be replaced with an intronic REMS or an intronic REMS may be inserted internally within an intron. In certain embodiments, in introducing a nucleotide sequence encoding an intronic REMS into an endogenous gene, care should be taken so as not to disrupt an open reading frame or introduce a stop codon. The introduction of a nucleotide sequence encoding an intronic REMS into an endogenous gene may or may not result in an amino acid change at the protein level. In certain embodiments, the introduction of a nucleotide sequence encoding an intronic REMS into an endogenous gene results in an amino acid change at the protein level. In some embodiments, this amino acid change is a conservative amino acid substitution. In other embodiments, the introduction of a nucleotide sequence encoding an intronic REMS into an endogenous gene does not result in an amino acid change at the protein level.

Kits

In one aspect, provided herein are kits comprising, in a container, an artificial gene construct or a vector comprising an artificial construct. In certain embodiments, the kits further comprise a compound described herein, in a separate container, and/or a negative control, such as phosphate buffered saline or a compound that does not recognize an intronic REMS, in a separate container. In a specific embodiment, the kits further comprise a positive control, such as a compound described herein as a positive control. In some embodiments, the kits further comprise primers and/or antibodies, in one or more separate containers, for assessing the production of an mRNA transcript from an artificial gene construct and/or protein production therefrom.

In another aspect, provided herein are kits comprising, in one or more containers, the components and/or reagents necessary to produce an artificial gene construct and/or a vector comprising an artificial gene construct. In another aspect, provided herein are kits comprising, in one or more containers, the components and/or reagents necessary to alter an endogenous gene so that it contains a nucleotide sequence encoding an intronic REMS or an additional nucleotide sequence encoding an intronic REMS (in other words, a REMS not naturally found in the endogenous gene, i.e., a non-endogenous REMS). In another aspect, provided herein are kits comprising, in one or more containers, the components and/or reagents necessary to alter an endogenous gene so that it contains a nucleotide sequence encoding an intronic REMS and contains a nucleotide sequence encoding a branch point and a nucleotide sequence encoding a 3' splice site upstream of the nucleotide sequence encoding the intronic REMS. In some embodiments, the kits further comprise primers and/or antibodies, in one or more separate containers, for assessing the production of an mRNA transcript from altered endogenous gene and/or protein production therefrom.

In another aspect, provided herein are kits comprising, in a container, a compound described herein, and instructions for use. In some embodiments, the kits further comprise a negative control, such as phosphate buffered saline or a compound that does not recognize an intronic REMS, in a separate container.

EXAMPLES

To describe in more detail and assist in understanding the present description, the following non-limiting biological examples are offered to more fully illustrate the scope of the description and are not to be construed as specifically limiting the scope thereof. Such variations of the present description that may be now known or later developed, which would be within the purview of one skilled in the art to ascertain, are considered to fall within the scope of the present description and as hereinafter claimed. The example below illustrates the existence of an intronic recognition element for splicing modifier (REMS) that is important for the recognition of a compound described herein, and the binding of such a compound to the intronic REMS on a precursor RNA permits or enhances the splicing of the precursor RNA, and suggests the usefulness of the intronic REMS in combination with a compound described herein for modulating RNA splicing, and for modulating the amount of a gene product.

Materials and Methods

Cell treatment: GM04856 lymphocyte cells were diluted in a medium composed of DMEM, 10% FBS and 1× Pen/Strep to a concentration of 2.5e5 cells/mL. 2 mL (500K cells) were seeded in 6-well plates and recovered for 4 h at 37° C., 5% $CO_2$. Compound dilutions were prepared as 2× compound stock in medium (e.g. for final 100 nM, make a 200 nM stock). After 4 h recovery, 2 mL of the 2× compound stock were added to each well, resulting in 4 mL/well with 1× final compound concentration. The cells were incubated for ~20 h at 37° C., 5% $CO_2$. After incubation, the cells were pelleted for 5 min at 1000 rpm. The supernatant was vacuum-removed and the cells were resuspended in 350 μl of RLT buffer (w/10 μl/mL beta-mercapto-ethanol, RNeasy kit). Total RNA was isolated using the RNeasy Mini Kit from Qiagen according to the manufacturer's instructions. The concentration of the resulting total RNA was determined using Nanodrop and diluted with water to a final concentration of 25 ng/μL.

Endpoint PCR: 20 μL endpoint RT-PCR5 were set up in 96-well plates using the AgPath-ID One-Step RT-PCR Reagents (Applied Biosystems) according to the manufacturer. Each reaction contained 200 nM forward primer, 200 nM reverse primer, and 50 ng total RNA. The following RT-PCR protocol was used: reverse transcription at 48° C. for 15 min, denaturation at 95° C. for 10 min, 35 PCR cycles with denaturation at 95° C. for 30 sec, annealing at 58° C. for 30 sec, and elongation at 68° C. for 1 min, final hold at 4° C. 10 μL of each RT-PCR reactions were analyzed on 2% 48-well E-Gels (Invitrogen) (pre-run 1 min, run 14 min) and imaged using an BioRad Gel Doc EZ Imager. The following size markers were used: TrackIt 1 Kb Plus DNA ladder and TrackIt 100 bp DNA ladder (10 μL/well, both Invitrogen).

Results: Oligonucleotides corresponding to exons that flank the intron where an iExon is located were used to amplify total RNA purified from untreated (DMSO) or cells treated with Compound 774 (at dose levels 10 nM, 1 μM or 10 μM). The resulting products were run on an agarose gel and the resulting bands of interest are demarcated by arrowheads, as shown in FIGS. 2A-D and 3-6A. In all cases, the increase of compound concentration results in appearance of a slower migrating PCR product containing the intronic-derived exon. In all cases, additional bands seen are intermediate spliced products.

Endpoint RT-PCR: Analysis of alternatively spliced mRNAs in cultured cells

GM03813 cells (Coriell Institute) derived from a patient with SMA type I (Coriell Institute) were plated at 5,000 cells/well in 200 μL DMEM with 10% FBS in 96-well plates, and incubated for 6 hours in a cell culture incubator (37° C., 5% $CO_2$, 100% relative humidity). Cells were then treated with certain representative compounds (e.g., Compound 774, Compound 702 and Compound 170) at different concentrations (in 0.5% DMSO) in duplicate for 24 hours. After removal of the supernatant, cells were lysed in Cells-To-Ct lysis buffer (Life Technologies, Inc.). Reverse transcription was performed using 5 μL of cell lysate and the iScript RT enzyme kit (Bio-Rad Laboratories, Inc). PCR was performed using 5 μL of cDNA and Platinum Taq HiFi DNA Polymerase (Life Technologies, Inc.) under the following PCR conditions: Step 1: 94° C. (2 min), Step 2: 94° C. (30 sec), Step 3: 55° C. (30 sec), Step 4: 68° C. (1 min), then repeat Steps 2 to 4 for 33 cycles, then hold at 4° C. Alternatively spliced mRNAs were identified using primers listed in Tables 8 and 9. PCR products were separated on 2% agarose E-gels, stained with ethidium bromide and visualized using a gel imager (UVP). Results for genes affected by intronic exons generated by treatment with Compound 774 are shown in Table 10.

TABLE 8

| Gene | Forward Primer | Sequence 5'-3' | SEQ ID NO. |
| --- | --- | --- | --- |
| ABCB8 | ABCB_54-73 | GCCGGCGGCTCCTGTTTTAC | 3629 |
| ANXA11 | ANXA_101-120 | AGTCGCTGTACCACGACATC | 3630 |
| ARL15 | ARL1_87-106-1a-KE | GCTGCCGGATGTCTGATCTC | 3631 |
| DCAF17 | DECA_23-43-KE | TGCTGTACCTTGCAGTGTTCC | 3632 |
| DHFR | DHFR_5-24 | CCATGAATCACCCAGGCCAT | 3633 |
| FAIM | FAIM_197-217-KE | GTGAAACCTACCCCAGAGCCT | 3634 |
| GXYLT1 | GXYL_57-77 | GGAAGCAATTGCCAAGAAGCA | 3635 |
| HTT | HTT_E49_For | TGCCCAGTCATTTGCACCTT | 3636 |
| MADD | MADD_137-156-KE | TGCCACAGGAAAGGGTCCTA | 3637 |
| MEMO1 | MEMO_37-56 | TGGAGCTCTGAGTGAGTCAA | 3638 |
| OXCT1 | OXCT_55-75-KE | GGCCTGACAGTGGATGACGTA | 3639 |
| PAPD4 | PAPD_46-65-KE | CCCGGAGCAGTGATGGTGAT | 3640 |
| PDXDC1 | *PDXD_23-42 | TGTGCCGTGTACCCTGTAAC | 3641 |
| PMS1 | PMS1_104-127-KE | TCTCCTCATGAGCTTTGGTATCCT | 3642 |
| PPIP5K2 | PPIP_34-57-KE | TCAGTTGACCTATCTCCCTCATGG | 3643 |
| PPP1R26 | PPP1R26e3F1 | CGTGTGGGAACACTGGCTG | 3644 |
| PRPF31 | RPRF_50-69-KE | GCCAACCGTATGAGCTTCGG | 3645 |
| RARS2 | RARS_30-53-KE | TTGGACATTTGCGTTCTACCATCA | 3646 |
| TNS3 | TNS3_6-29-KE | CCAGGTGATAAACTTGTGATCGTG | 3647 |
| WNK1 | Wnk1_45-67 | GCTGGTGTTTTAAGATGGGACG | 3648 |

TABLE 8-continued

| Gene | Forward Primer | Sequence 5'-3' | SEQ ID NO. |
|---|---|---|---|
| SF3B | SF3B_107-127-2a | GGCATCAGCTTTGCCATTCAT | 3649 |
| SF3B | SF3B_134-153-9a | TTGGACAGCCTCTCTCCCAT | 3650 |
| MEMO1 | MEMO_37-56 | TGGAGCTCTGAGTGAGTCAA | 3651 |
| DHFR | DHFR_5-24 | CCATGAATCACCCAGGCCAT | 3652 |
| GCFC2 | GCFC2e2F1 | GGAGAAAAGAACTTTCATCAACAG | 3653 |
| FAM174A | FAM174Ae2F1 | CAGGATGATGAGGATGATGACAAc | 3654 |
| SOS2 | SOS2e19F1 | CTGAAAAAGAGTTTACAGATTATTTGTTC | 3655 |
| COPS7B | COPS7Be2F1 | CGGAGTGTATGTCTTTGGAGAACTT | 3656 |
| LMBRD2 | LMBRD2e16R1 | GGAATCTTCTCTATTGTGTCCATAACG | 3657 |
| ASAP1 | ASAP1e11F1 | TACCCCTTCTTTTCACTGCCAT | 3658 |
| PPP1R26 | PPP1R26e3F1 | CGTGTGGGAACACTGGCTG | 3659 |
| NT5C2 | NT5C2e12F1 | AAACCACTCTTTTTGGAGAAGGC | 3660 |
| ELMO2 | ELMO2e2F1 | AGGTGTAGAAAGAGGTACATGGAGAA | 3661 |

TABLE 9

| Gene | Reverse Primer | Sequence 5'-3' | SEQ ID NO. |
|---|---|---|---|
| ABCB8 | ABCB_235-254 | AGGAGCTGCGGTAGCCATCA | 3662 |
| ANXA11 | ANXA_302-321 | GAGCCACCAGTCACTGTTCA | 3663 |
| ARL15 | ARL1_392-411-1a-KE | TGAGGCCTATGCAAACCAGG | 3664 |
| DCAF17 | DECA_168-190-KE | CCATGAGACAAGGTAGCATCTGT | 3665 |
| DHFR | DHFR_209-228 | TGCCTTTCTCCTCCTGGACA | 3666 |
| FAIM | FAIM_367-388-KE | AGCAACATCCCAAACAGCTACG | 3667 |
| GXYLT1 | GXYL_246-268 | AGGAACGGATGTTGTCATCTTCA | 3668 |
| HTT | HTT_E51_Rev | GGGTATTTGTCCTTCTTTCT | 3669 |
| MADD | MADD_288-309-KE | TCTCCTCTGTCTCACCAAGGTC | 3670 |
| MEMO1 | MEMO_218-239 | TCCCCCTGGGATTCATCATAGT | 3671 |
| OXCT1 | OXCT_236-256-KE | AATGAAAAACACGCAGCCTGG | 3672 |
| PAPD4 | PAPD_183-205-KE | AAGGTGAGTATATGCCGTGCTTC | 3673 |
| PDXDC1 | *PDXD_179-199 | CAAGCAACAGGGGCAGTCTTC | 3674 |
| PMS1 | PMS1_285-308-KE | ACATGAGAGCCATCTTGTGATCTG | 3675 |
| PPIP5K2 | PPIP_149-172-KE | TTCACCTCCCCATTTTAGAACCAA | 3676 |
| PPP1R26 | PPP1R26e4R1 | GCGATGCTTTATTTCTCTACCG | 3677 |
| PRPF31 | RPRF_218-237-KE | TCGTTTACCTGTGTCTGCCG | 3678 |
| RARS2 | RARS_251-270-KE | ATGCCCCAATCGCCAAGGTA | 3679 |
| TNS3 | TNS3_96-116-KE | CGGCTCCTTGTCCTTCAACAT | 3680 |
| WNK1 | Wnk1_187-207 | CTGAGGACTCTGAGGTGCTGG | 3681 |
| SF3B | SF3B_256-275-2a | GTACTTTGCCAGTGTTGGGG | 3682 |
| SF3B | SF3B_304-324-9a | ACTCTCAGAGATGATCGGGGT | 3683 |

TABLE 9-continued

| Gene | Reverse Primer | Sequence 5'-3' | SEQ ID NO. |
|---|---|---|---|
| MEMO1 | MEMO_218-239 | TCCCCCTGGGATTCATCATAGT | 3684 |
| DHFR | DHFR_209-228 | TGCCTTTCTCCTCCTGGACA | 3685 |
| GCFC2 | GCFC2e3R1 | GAATAAAAGCTGCATCTGGGATC | 3686 |
| FAM174A | FAM174Ae3R1 | CAACATTGATATAGTGGCTTCTTATTC | 3687 |
| SOS2 | SOS2e20R1 | CTGAAGAAGCAGATACTGGTGGAG | 3688 |
| COPS7B | COPS7Be3R1 | GTATGTCCCATAGGCAAACAGGTT | 3689 |
| LMBRD2 | LMBRD2e15F1 | AAAGGCAAGAAGAAGGTGAAAATC | 3690 |
| ASAP1 | ASAP1e12R1 | GCTAACTGCACTCCGAGACTTAAT | 3691 |
| PPP1R26 | PPP1R26e4R1 | GCGATGCTTTATTTCTCTACCG | 3692 |
| NT5C2 | NT5C2e13R1 | TAGACGATACCATGCTGTAGGGG | 3693 |
| ELMO2 | ELMO_232-252 | TTGATAATGGATGCCAGGGGC | 3694 |

Results: The statistically significant value for the likelihood of iExon production (ΔPSI) according to the Fisher's Exact Test (FET) for PNN and HDF cell lines treated with Compound 774 at 3 μM and Fold Decrease (FD) for certain genes tested, where NR represents "Not Reported," is shown in Table 10.

The ΔPSI for inclusion of an iExon and resulting modulated expression of RNA transcripts identified is represented by stars, where one star (*) represents ≤25% change in expression, where two stars () represent change in expression in a range from <26% to ≤50% change, where three stars (*) represent change in expression in a range from <51% to ≤75% change, and, where four stars (****) represent change in expression in a range from <75% to ≤100% change.

TABLE 10

| Gene Symbol | Inclusion Position | ΔPSI (PNN) | FET ΔPSI (PNN) | FD PNN | ΔPSI (HDF) | FET ΔPSI (HDF) | FD HDF |
|---|---|---|---|---|---|---|---|
| ABCB8 | i1 | ** | 9.42E-16 | NR | ** | 3.66E-09 | NR |
| ABCC3 | 130 | ** | 6.00E-07 | -0.25 | * | 1 | -1.03 |
| ADAM17 | i1 | ** | 7.83E-11 | NR | * | 4.87E-08 | NR |
| ADCY3 | i6 | * | 0.003 | NR | * | 0.656286 | NR |
| AGPAT4 | i1 | * | 1.13E-05 | NR | ** | 1.21E-06 | NR |
| ANKRA2 | 15 | * | 0.28 | -1.05 | * | 0.001 | 0.73 |
| ANXA11 | i16 | * | 9.07E-56 | NR | * | 2.24E-20 | NR |
| APIP | i1 | * | 2.52E-11 | NR | * | 1.42E-19 | NR |
| APPL2 | i1 | * | 4.28E-06 | NR | * | 0.47 | NR |
| ARHGAP1 | i1 | * | 0.34 | -0.11 | * | 0.01 | -1.02 |
| ARL15 | i4 | ** | 1.77E-08 | NR | * | 1.94E-05 | NR |
| ARL15 | i1 | **** | 1.20E-17 | NR | *** | 2.25E-18 | NR |
| ASAP1 | i12 | * | 0 | -0.79 | * | 0 | -1.40 |
| ASAP1 | i19 | * | 0 | -0.79 | * | 0 | -1.40 |
| ASAP1 | i19 | * | 0.0003 | -0.79 | * | 0.22 | -1.40 |
| ASAP1 | i12 | * | 0.004 | -0.79 | * | 1 | -1.40 |
| ASPH | i24 | * | 1 | NR | * | 0.19 | NR |
| ATAD2B | i27 | * | 0.51 | NR | * | 0.47 | NR |
| ATXN1 | i7 | * | 0.08 | NR | * | 1 | NR |
| BECN1 | i11 | * | 3.01E-18 | NR | * | 5.27E-06 | NR |
| BHMT2 | i2 | * | 0.05 | NR | * | 1 | NR |
| BICD1 | i5 | * | 2.64E-05 | NR | * | 0.06 | NR |
| BTN3A1 | i1 | * | 0.02 | NR | * | 0.0001 | NR |
| C11orf30 | i20 | *** | 3.45E-12 | -0.82 | *** | 3.57E-10 | -1.06 |
| C11orf73 | i2 | ** | 1.10E-47 | -1.44 | * | 2.53E-40 | 0.52 |
| C12orf4 | i1 | **** | 2.07E-43 | NR | **** | 1.91E-66 | NR |
| C14orf132 | i1 | * | 0.16 | NR | * | 0.04 | NR |
| C8orf44 | i1 | *** | 0.004 | NR | * | 1 | NR |
| C8orf44-SGK3 | i1 | *** | 1.17E-08 | NR | ** | 0.06 | NR |
| C8orf88 | i3 | * | 0.13 | NR | * | 4.31E-05 | NR |
| CASC3 | i3 | * | 0.04 | -0.48 | * | 0.08 | -1.14 |
| CASP7 | i2 | * | 0.001 | NR | * | 1.99E-06 | NR |
| CCDC122 | i6 | * | 0.29 | -1.07 | * | 1 | 0.41 |
| CDH13 | i7 | * | 0.0003 | -2.06 | * | 1.32E-05 | -0.76 |
| CECR7 | i3 | **** | 3.06E-07 | NR | **** | 0.14 | NR |

TABLE 10-continued

| Gene Symbol | Inclusion Position | ΔPSI (PNN) | FET ΔPSI (PNN) | FD PNN | ΔPSI (HDF) | FET ΔPSI (HDF) | FD HDF |
|---|---|---|---|---|---|---|---|
| CENPI | i19 | **** | 1.62E−50 | NR | *** | 1.78E−58 | NR |
| CEP112 | i24 | * | 0.11 | −0.96 | * | 0.02 | −0.62 |
| CEP192 | i13 | * | 0.03 | NR | * | 0.34 | NR |
| CHEK1 | i13 | ** | 3.38E−05 | NR | * | 0.0002 | NR |
| CMAHP | i6 | * | 1 | −1.59 | *** | 0.002 | −0.47 |
| CNRIP1 | i2 | * | 3.10E−22 | NR | * | 1.70E−42 | NR |
| CNRIP1 | i15 | * | 1.62E−17 | NR | * | 2.06E−34 | NR |
| COPS7B | i2 | * | 1.45E−22 | NR | * | 4.58E−14 | NR |
| CP | SF4i2 | * | 0.009 | NR | * | 0.40 | NR |
| CRISPLD2 | i1 | *** | 0.009 | −0.25 | *** | 0.001 | −1.29 |
| CRYBG3 | i17 | * | 1 | −0.33 | * | 1 | −1.08 |
| CSNK1E | i3 | **** | 1.50E−07 | NR | *** | 0.004 | NR |
| CSNK1G1 | i2 | * | 0.004 | NR | * | 1 | NR |
| DCAF17 | i2 | * | 0.06 | NR | * | 1 | NR |
| DCAF17 | i6 | **** | 1.01E−17 | NR | ** | 9.85E−15 | NR |
| DCUN1D4 | i8 | * | 0.05 | −1.16 | * | 3.90E−17 | −0.01 |
| DDX42 | i8 | * | 9.24E−17 | −1.26 | * | 0.0002 | −1.62 |
| DENND1A | i10 | ** | 0.0005 | −2.20 | *** | 8.97E−07 | −2.09 |
| DENND5A | i3 | * | 0 | −2.48 | * | 0 | −2.09 |
| DENND5A | i8 | * | 0 | −2.48 | * | 0 | −2.09 |
| DGKA | i10 | * | 0.02 | NR | * | 0.22 | NR |
| DHFR | is | **** | 2.99E−06 | NR | *** | 0.0006 | NR |
| DHFR | is | **** | 5.92E−08 | NR | *** | 0.0004 | NR |
| DIAPH3 | i27 | * | 8.17E−12 | −2.51 | * | 4.97E−12 | −2.14 |
| DIAPH3 | i15 | ** | 8.33E−15 | −2.51 | * | 1.10E−08 | −2.14 |
| DNAJC13 | i43 | * | 0.05 | −0.23 | * | 0.33 | −1.05 |
| DNMBP | i1 | * | 0.66 | −0.32 | * | 0.62 | −0.99 |
| DNMBP | i11 | * | 0.001 | −0.32 | * | 0.11 | −0.99 |
| DOCK1 | i23 | * | 2.18E−13 | −1.29 | * | 0.0006 | −1.28 |
| DYRK1A | i3 | * | 0.01 | NR | * | 0.33 | NR |
| EIF2B3 | i6 | * | 0.0005 | −1.86 | * | 1.49E−06 | −0.82 |
| ENAH | i1 | ** | 9.79E−34 | NR | ** | 7.69E−23 | NR |
| ENOX1 | is | * | 0 | −1.28 | * | 0 | −0.68 |
| EP300 | i1 | * | 0.0006 | 0.13 | * | 1 | −1.19 |
| ERC1 | i18 | ** | 4.96E−20 | −0.53 | * | 0.0002 | −1.49 |
| ERLIN2 | i1 | * | 4.62E−06 | NR | * | 0.12 | NR |
| ERRFII | i1 | **** | 0.004 | NR | * | 1 | NR |
| EVC | i5 | * | 1.62E−12 | −0.53 | * | 0.23 | −0.96 |
| FAF1 | i14 | * | 0.21 | −1.32 | * | 0.009 | −0.83 |
| FAIM | i2 | * | 0.08 | NR | * | 0.30 | NR |
| FAM126A | i7 | * | 5.38E−10 | NR | * | 1.31E−05 | NR |
| FAM13A | i4 | * | 0.49 | NR | * | 0.04 | NR |
| FAM162A | i1 | **** | 2.03E−84 | NR | *** | 6.15E−83 | NR |
| FAM174A | i2 | * | 0.001 | NR | * | 0.0006 | NR |
| FBN2 | i5 | ** | 5.89E−26 | −0.69 | ** | 9.15E−22 | −1.75 |
| FER | i13 | ** | 0.02 | −1.81 | * | 0.001 | −1.26 |
| FHOD3 | i21 | * | 2.20E−06 | −0.60 | * | 2.48E−05 | −1.23 |
| FOCAD | i6 | * | 0.01 | NR | * | 1 | NR |
| GALC | i6 | *** | 2.48E−07 | −2.21 | *** | 2.31E−06 | −2.14 |
| GCFC2 | i11 | * | 1 | −1.34 | * | 0.18 | −0.27 |
| GGACT | i2 | * | 0.24 | NR | * | 0.49 | NR |
| GLCE | i2 | * | 0.01 | NR | * | 0.01 | NR |
| GOLGA4 | i1 | * | 1 | −0.24 | * | 0.31 | −0.98 |
| GOLGB1 | i14 | * | 1 | −1.32 | * | 1.24E−05 | −1.24 |
| GPSM2 | i1 | ** | 0.0004 | NR | * | 0.14 | NR |
| GULP1 | i1 | *** | 0.001 | NR | ** | 0.0006 | NR |
| GXYLT1 | i7 | * | 4.54E−05 | NR | * | 0.02 | NR |
| HDX | i1 | **** | 1.66E−05 | NR | *** | 1.11E−05 | NR |
| HLTF | i14 | * | 1 | −1.76 | * | 0.19 | −1.75 |
| HMGA2 | i3 | * | 2.99E−06 | NR | * | 0.003 | NR |
| HNMT | i1 | * | 0.03 | NR | * | 0.89 | NR |
| HSD17B12 | i6 | *** | 3.41E−16 | −2.92 | ** | 1.16E−39 | −2.39 |
| HSD17B4 | i2 | * | 5.71E−06 | NR | * | 0.002 | NR |
| HTT | i49 | ** | 6.23E−08 | −1.21 | *** | 2.98E−05 | −1.86 |
| IFT57 | i5 | * | 2.26E−15 | NR | * | 1.31E−18 | NR |
| IVD | i7 | * | 6.58E−13 | NR | * | 4.50E−12 | NR |
| KDM6A | i26 | ** | 4.61E−14 | NR | ** | 1.87E−11 | NR |
| KIAA1524 | i11 | * | 0 | −1.43 | * | 0 | −0.62 |
| KIAA1715 | i6 | * | 0 | −1.41 | * | 0 | 0.05 |
| LETM2 | i8 | ** | 5.73E−05 | NR | * | 1 | NR |
| LOC400927 | i3 | **** | 1.50E−07 | NR | * | 0.004 | NR |
| LRRC42 | i2 | ** | 8.25E−09 | NR | * | 0.01 | NR |
| LUC7L3 | i1 | * | 4.59E−06 | NR | * | 0.003 | NR |
| LYRM1 | i2 | * | 3.63E−06 | NR | * | 4.98E−14 | NR |
| MB21D2 | i1 | * | 0.007 | NR | * | 0.002 | NR |
| MCM10 | i15 | * | 0.0009 | NR | * | 1 | NR |

TABLE 10-continued

| Gene Symbol | Inclusion Position | ΔPSI (PNN) | FET ΔPSI (PNN) | FD PNN | ΔPSI (HDF) | FET ΔPSI (HDF) | FD HDF |
|---|---|---|---|---|---|---|---|
| MED13L | i3 | * | 1 | −0.17 | * | 1 | −1.11 |
| MED13L | i22 | * | 0.07 | −0.17 | * | 1 | −1.11 |
| MEDAG | i2 | ** | 0.0004 | −2.40 | * | 0.01 | −1.60 |
| MEMO1 | i6 | ** | 2.42E−35 | −1.30 | * | 5.11E−40 | −0.56 |
| MFN2 | i1 | **** | 1.08E−90 | NR | *** | 8.82E−42 | NR |
| MMS19 | i2 | * | 0 | −1.36 | * | 0 | −1.75 |
| MRPL45 | i4 | * | 4.39E−11 | NR | * | 1.75E−10 | NR |
| MRPS28 | i2 | * | 1.43E−09 | NR | * | 0.003 | NR |
| MTERF3 | i3 | * | 1.38E−07 | −1.63 | * | 1.74E−18 | −0.19 |
| MYCBP2 | i80 | * | 2.71E−06 | −0.36 | * | 0.04 | −1.12 |
| MYCBP2 | i55 | *** | 1.44E−05 | −0.36 | ** | 0.03 | −1.12 |
| MYLK | i5 | * | 5.54E−09 | 0.23 | * | 3.75E−06 | −1.10 |
| MYOF | i29 | * | 0.01 | −0.82 | * | 0.003 | −1.75 |
| NGF | i1 | **** | 1.75E−69 | NR | *** | 2.47E−53 | NR |
| NREP | i3 | * | 0.0002 | −1.31 | * | 0.46 | −0.10 |
| NSUN4 | i5 | ** | 1.90E−09 | −1.48 | * | 1.80E−08 | −0.67 |
| NT5C2 | i11 | * | 2.32E−11 | −1.26 | * | 4.54E−07 | −0.05 |
| OSMR | i3 | * | 0.004 | −0.14 | * | 0.03 | −0.97 |
| OXCT1 | i16 | * | 0.0005 | NR | * | 0.46 | NR |
| PAPD4 | i7 | **** | 2.37E−32 | −2.33 | **** | 3.72E−52 | −1.40 |
| PCM1 | i15 | * | 0.06 | −1.30 | * | 0.10 | −0.86 |
| PDE7A | i2 | *** | 1.46E−10 | NR | *** | 3.25E−09 | NR |
| PDS5B | i13 | * | 0.03 | −0.42 | * | 0.03 | −1.02 |
| PDXDC1 | i7 | *** | 1.09E−13 | NR | *** | 4.13E−18 | NR |
| PIGN | i22 | ** | 1.35E−20 | NR | * | 1.27E−26 | NR |
| PIK3CD | i3 | ** | 3.02E−06 | NR | * | 0.32 | NR |
| PIK3R1 | i2 | * | 0.02 | −0.83 | ** | 6.81E−10 | −1.06 |
| PIKFYVE | i12 | * | 0.02 | NR | * | 0.002 | NR |
| PITPNB | i7 | * | 1 | −1.45 | * | 0.03 | −1.17 |
| PITPNB | i7 | * | 4.52E−05 | −1.45 | * | 2.70E−07 | −1.17 |
| PLEKHA1 | i1 | ** | 0.006 | NR | ** | 0.002 | NR |
| PLSCR1 | i1 | * | 0.0008 | NR | * | 1 | NR |
| PMS1 | i5 | **** | 1.49E−07 | −2.57 | *** | 3.56E−24 | −1.02 |
| POMT2 | i13 | **** | 2.02E−40 | NR | **** | 5.83E−53 | NR |
| PPARG | i4 | * | 0.04 | NR | * | 1 | NR |
| PPIP5K2 | i13 | * | 4.52E−11 | NR | * | 1.70E−05 | NR |
| PPP1R26 | i3 | ** | 3.54E−09 | NR | * | 0.0007 | NR |
| PRPF31 | i11 | ** | 2.66E−39 | NR | * | 8.15E−18 | NR |
| PRSS23 | i3 | * | 9.82E−07 | NR | * | 0.10 | NR |
| PSMA4 | i4 | * | 1.45E−09 | NR | * | 1.80E−20 | NR |
| PXK | i1 | * | 8.38E−05 | NR | * | 2.07E−06 | NR |
| RAF1 | i7 | * | 4.10E−37 | NR | * | 3.85E−24 | NR |
| RAPGEF1 | i11 | *** | 1.30E−07 | NR | **** | 5.56E−05 | NR |
| RARS2 | i6 | * | 2.50E−20 | NR | * | 5.90E−08 | NR |
| RBKS | i1 | ** | 0.0004 | NR | ** | 0.002 | NR |
| RERE | i13 | ** | 3.04E−07 | 0.02 | ** | 3.70E−05 | −1.06 |
| RFWD2 | i11 | * | 1.50E−13 | −2.40 | * | 3.95E−16 | −0.90 |
| RPA1 | i1 | * | 3.28E−12 | NR | * | 0.006 | NR |
| RPS10 | i5 | * | 9.72E−28 | NR | * | 3.15E−20 | NR |
| SAMD4A | i1 | * | 0.003 | NR | * | 0.001 | NR |
| SAR1A | i1 | * | 1.85E−48 | NR | * | 8.33E−65 | NR |
| SCO1 | i4 | * | 5.88E−07 | NR | * | 6.67E−08 | NR |
| SEC24A | i7 | * | 0.003 | NR | * | 0.008 | NR |
| SENP6 | i2 | **** | 5.51E−84 | NR | **** | 3.10E−77 | NR |
| SERGEF | i1 | **** | 0.14 | −1.02 | * | 1 | −0.81 |
| SGK3 | i1 | *** | 1.17E−08 | NR | ** | 0.06 | NR |
| SLC12A2 | i10 | *** | 7.56E−18 | NR | * | 0.0008 | NR |
| SLC25A17 | i2 | *** | 7.32E−38 | NR | *** | 3.49E−74 | NR |
| SLC44A2 | i21 | * | 1.56E−06 | 0.06 | * | 0.002 | −0.99 |
| SMYD3 | i5 | * | 0.0001 | −1.40 | * | 9.36E−06 | 0.33 |
| SNAP23 | i3 | **** | 6.29E−112 | −2.82 | *** | 1.22E−150 | −0.89 |
| SNHG16 | i1 | * | 1.92E−18 | −1.68 | * | 5.75E−14 | −0.99 |
| SNX7 | i7 | * | 3.44E−26 | NR | * | 8.14E−24 | NR |
| SOS2 | i19 | ** | 1.39E−10 | NR | * | 2.76E−05 | NR |
| SPATA5 | i10 | * | 1 | NR | * | 0.27 | NR |
| SPIDR | i1 | * | 3.23E−08 | NR | * | 0.007 | NR |
| SPRYD7 | i4 | * | 2.80E−05 | NR | * | 7.62E−07 | NR |
| SRGAP1 | i1 | * | 0.001 | −0.16 | * | 0.0002 | −0.99 |
| S RRM1 | i3 | * | 1 | 0.14 | * | 1 | −1.05 |
| STAT1 | i21 | * | 7.01E−09 | −3.06 | * | 7.52E−31 | −1.86 |
| STXBP6 | i2 | * | 9.26E−08 | NR | * | 1 | NR |
| STXBP6 | i1 | **** | 6.15E−14 | NR | *** | 2.75E−05 | NR |
| SUPT2OH | i24 | * | 5.05E−07 | NR | * | 0.22 | NR |
| TAF2 | i20 | * | 0 | −1.03 | * | 0 | −0.57 |
| TAF2 | i23 | *** | 6.92E−18 | −1.02754 | ** | 3.95E−12 | −0.57 |
| TASP1 | i13 | *** | 7.02E−08 | NR | ** | 6.32E−05 | NR |

TABLE 10-continued

| Gene Symbol | Inclusion Position | ΔPSI (PNN) | FET ΔPSI (PNN) | FD PNN | ΔPSI (HDF) | FET ΔPSI (HDF) | FD HDF |
|---|---|---|---|---|---|---|---|
| TBC1D15 | i5 | * | 0.12 | NR | * | 1 | NR |
| TCF12 | i3 | * | 1.21E-22 | NR | * | 3.63E-15 | NR |
| TCF4 | i4 | * | 3.51E-22 | NR | * | 7.89E-07 | NR |
| TIAM1 | i4 | *** | 0.05 | NR | * | 1 | NR |
| TJP2 | i1 | * | 0.02 | NR | * | 0.25 | NR |
| TMC3 | i2 | ** | 0.18 | NR | * | 0.45 | NR |
| TMEM214 | i8 | * | 1.97E-56 | NR | * | 4.75E-07 | NR |
| TNRC6A | i4 | *** | 1.38E-21 | NR | ** | 1.08E-10 | NR |
| TNS3 | i23 | ** | 0.0007 | -2.76 | * | 0.007 | -2.74 |
| TOE1 | i4 | * | 3.34E-05 | NR | * | 0.002 | NR |
| TRAF3 | i8 | * | 0.0004 | -0.54 | * | 0.14 | -0.97 |
| TSPAN2 | i4 | *** | 1.12E-18 | -1.06 | ** | 1.81E-08 | -0.58 |
| TTC7B | i5 | * | 3.09E-06 | NR | * | 8.95E-05 | NR |
| TYW5 | i1 | * | 0.0009 | NR | * | 0.10 | NR |
| UBAP2L | i24 | ** | 5.24E-52 | NR | * | 1.43E-35 | NR |
| URGCP | i1 | * | 0.15 | NR | * | 0.32 | NR |
| VAV2 | i4 | ** | 2.55E-08 | NR | ** | 1.65E-07 | NR |
| WDR27 | i2 | ** | 0.003 | NR | * | 1 | NR |
| WDR27 | i9 | ** | 0.008 | NR | ** | 0.09 | NR |
| WDR37 | i9 | ** | 0.0009 | NR | ** | 0.03 | NR |
| WDR91 | i5 | *** | 7.69E-06 | NR | ** | 0.0006 | NR |
| WNK1 | i23 | * | 0.01 | 0.071985 | * | 1 | -1.26 |
| XRN2 | i3 | * | 1 | -1.29088 | * | 1 | -0.55 |
| XRN2 | i16 | * | 3.25E-07 | -1.29088 | * | 1.05E-08 | -0.55 |
| ZCCHC8 | i11 | * | 5.24E-10 | NR | * | 4.65E-08 | NR |
| ZFP82 | i4 | ** | 9.95E-06 | NR | ** | 1.56E-08 | NR |
| ZNF138 | i3 | *** | 0.025 | NR | * | 0.07 | NR |
| ZNF232 | i4 | * | 0.23 | NR | * | 0.02 | NR |
| ZNF37BP | i4 | **** | 0.003 | NR | *** | 0.03 | NR |

Results: The statistically significant value for the likelihood of exon inclusion (ΔPSI) according to the Fisher's Exact Test (FET) for PNN and HDF cell lines treated with Compound 774 at 3 μM and Fold Decrease (FD) for certain genes tested, where NR represents "Not Reported," is shown in Table 10a.

The ΔPSI for inclusion of an exon and resulting modulated expression of RNA transcripts identified is represented by stars, where one star (*) represents ≤25% change in expression, where two stars () represent change in expression in a range from <26% to ≤50% change, where three stars (*) represent change in expression in a range from <51% to ≤75% change, and, where four stars (****) represent change in expression in a range from <75% to ≤100% change.

TABLE 10a

| Gene Symbol | Inclusion Position | ΔPSI (PNN) | FET ΔPSI (PNN) | FD PNN | ΔPSI (HDF) | FET ΔPSI (HDF) | FD HDF |
|---|---|---|---|---|---|---|---|
| APLP2 | e7 | ** | 0 | NR | ** | 2.69E-271 | NR |
| AXIN1 | e9 | ** | 0.004 | NR | * | 1 | NR |
| CECR7 | e5 | * | 0.02 | NR | * | 1 | NR |
| DAGLB | e4 | * | 0.74 | NR | * | 0.43 | NR |
| DLGAP4 | e8 | * | 1.12E-13 | NR | * | 1.12E-07 | NR |
| ERCC1 | e8 | * | 0.0009 | NR | * | 0.20 | NR |
| ERGIC3 | e8 | * | 1.44E-220 | NR | * | 2.39E-209 | NR |
| FAM198B | e3 | * | 0.003 | -1.81 | * | 0.20 | -0.35 |
| GGCT | e2 | ** | 1.36E-30 | NR | ** | 5.86E-45 | NR |
| HAT1 | e3 | * | 6.50E-11 | NR | * | 1.34E-10 | NR |
| HPS1 | e5 | * | 0.01 | NR | * | 0.34 | NR |
| INPP5K | e2 | * | 0.53 | NR | * | 0.14 | NR |
| MADD | e21 | * | 2.28E-08 | NR | * | 7.00E-07 | NR |
| PPHLN1 | e3 | *** | 8.22E-83 | NR | ** | 8.90E-66 | NR |
| PRUNE2 | e18 | * | 0.52 | -0.52 | ** | 0.05 | -1.74 |
| RAP1A | e2 | * | 3.80E-15 | NR | * | 4.27E-07 | NR |
| RNFT1 | e3 | * | 0.02 | NR | * | 6.02E-07 | NR |
| RPS6KB2 | e2 | * | 0.14 | NR | * | 1 | NR |
| SH3YL1 | e9 | * | 0.009 | NR | * | 0.08 | NR |
| SKA2 | e3 | * | 0.0001 | NR | * | 0.05 | NR |
| SPATA18 | e4 | ** | 1.50E-05 | NR | * | 0.29 | NR |
| STRN3 | e8 | **** | 4.13E-54 | NR | *** | 4.39E-44 | NR |
| TMEM189-UBE2V1 | e6 | * | 2.19E-30 | NR | * | 4.66E-20 | NR |
| TRIM65 | e5 | *** | 2.49E-11 | NR | ** | 0.0002 | NR |
| TUBE1 | e4 | * | 7.36E-05 | NR | * | 2.05E-10 | NR |
| UBE2V1 | e3 | * | 2.19E-30 | NR | * | 4.66E-20 | NR |

TABLE 10a-continued

| Gene Symbol | Inclusion Position | ΔPSI (PNN) | FET ΔPSI (PNN) | FD PNN | ΔPSI (HDF) | FET ΔPSI (HDF) | FD HDF |
|---|---|---|---|---|---|---|---|
| VPS29 | e2 | ** | 3.05E−17 | NR | ** | 2.61E−38 | NR |
| ZNF680 | e3 | * | 0.13 | NR | * | 0.32 | NR |

Details on the location of the iExon produced in affected genes from Table 10 are shown in Table 11.

TABLE 11

| Gene Symbol | Ref SeqID | Coordinates | Description |
|---|---|---|---|
| ABCB8 | NM_007188 | chr7:150728328-150728378 | ATP-binding cassette, sub-family B (MDR/TAP), member 8 |
| ABCC3 | NM_003786 | chr17:48767318-48767437 | ATP-binding cassette, sub-family C (CFTR/MRP), member 3 |
| ADAM17 | NM_003183 | chr2:9683889-9683825 | ADAM metallopeptidase domain 17 |
| ADCY3 | NM_004036 | chr2:25061781-25061716 | adenylate cyclase 3 |
| AGPAT4 | NM_020133 | chr6:161687802-161687740 | 1-acylglycerol-3-phosphate O-acyltransferase 4 |
| ANKRA2 | NM_023039 | chr5:72851082-72850950 | ankyrin repeat, family A (RFXANK-like), 2 |
| ANXA11 | NM_001278407 | chr10:81916254-81916134 | annexin A11 |
| APIP | NM_015957 | chr11:34933660-34933520 | APAF1 interacting protein |
| APLP2 | NM_001642 | chr11:129993507-129993674 | amyloid beta (A4) precursor-like protein 2 |
| APPL2 | NM_018171 | chr12:105625422-105625147 | adaptor protein, phosphotyrosine interaction, PH domain and leucine zipper containing 2 |
| ARHGAP1 | NM_004308 | chr11:46718619-46718571 | Rho GTPase activating protein 1 |
| ARL15 | NM_019087 | chr5:53212951-53212826 | ADP-ribosylation factor-like 15 |
| ASAP1 | NM_001247996 | chr8:131173039-131173031 | ArfGAP with SH3 domain, ankyrin repeat and PH domain 1 |
| ASAP1 | NM_001247996 | chr8:131135828-131135650 | ArfGAP with SH3 domain, ankyrin repeat and PH domain 1 |
| ASAP1 | NM_001247996 | chr8:131135731-131135650 | ArfGAP with SH3 domain, ankyrin repeat and PH domain 1 |
| ASAP1 | NM_001247996 | chr8:131173046-131173031 | ArfGAP with SH3 domain, ankyrin repeat and PH domain 1 |
| ASPH | NM_004318 | chr8:62,421,470-62,421,527 | aspartate beta-hydroxylase |
| ATAD2B | NM_001242338 | chr2:23976387-23976214 | ATPase family, AAA domain containing 2B |
| ATXN1 | NM_000332 | chr6:16409524-16409426 | ataxin 1 |
| AXIN1 | NM_003502 | chr16:341297-341190 | axin 1 |
| BECN1 | NM_003766 | chr17:40963348-40963310 | beclin 1, autophagy related |
| BHMT2 | NM_017614 | chr5:78374568-78374655 | betaine--homocysteine S-methyltransferase 2 |
| BICD1 | NM_001714 | chr12:32486172-32486263 | bicaudal D homolog 1 (Drosophila) |
| BTN3A1 | NM_001145008 | chr6:26404363-26404455 | butyrophilin, subfamily 3, member A1 |
| C11orf30 | NM_020193 | chr11:76259972-76260061 | chromosome 11 open reading frame 30 |
| C11orf73 | NR_024596 | chr11:86037555-86037718 | chromosome 11 open reading frame 73 |
| C12orf4 | NM_020374 | chr12:4646680-4646546 | chromosome 12 open reading frame 4 |
| C14orf132 | NM_001252507 | chr14:96506612-96506704 | chromosome 14 open reading frame 132 |
| C8orf44 | NM_019607 | chr8:67588980-67589137 | chromosome 8 open reading frame 44 |
| C8orf44-SGK3 | NM_001204173 | chr8:67697924-67698031 | C8orf44-SGK3 readthrough |
| C8orf88 | NM_001190972 | chr8:91990874-91990807 | chromosome 8 open reading frame 88 |
| CASC3 | NM_007359 | chr17:38298307-38298353 | cancer susceptibility candidate 3 |
| CASP7 | NM_033340 | chr10:115477382-115477512 | caspase 7, apoptosis-related cysteine peptidase |
| CCDC122 | NM_144974 | chr13:44431087-44431054 | coiled-coil domain containing 122 |
| CDH13 | NM_001220488 | chr16:83402146-83402179 | cadherin 13 |
| CECR7 | NM_014339 | chr22:17,535,915-17,535,996 | cat eye syndrome chromosome region, candidate 7 (non-protein coding) |
| CECR7 | NR_015352 | chr22:17535855-17535996 | cat eye syndrome chromosome region, candidate 7 (non-protein coding) |
| CENPI | NM_006733 | chrX:100411511-100411544 | centromere protein I |
| CEP112 | NM_001199165 | chr17:63684725-63684629 | centrosomal protein 112 kDa |
| CEP192 | NM_032142 | chr18:13038514-13038578 | centrosomal protein 192 kDa |
| CHEK1 | NM_001114121 | chr11:125526101-125526230 | checkpoint kinase 1 |
| CMAHP | NR_002174 | chr6:25107418-25107336 | cytidine monophospho-N-acetylneuraminic acid hydroxylase, pseudogene |
| CNRIP1 | NM_001111101 | chr2:68542975-68542840 | cannabinoid receptor interacting protein 1 |

TABLE 11-continued

| Gene Symbol | Ref SeqID | Coordinates | Description |
|---|---|---|---|
| CNRIP1 | NM_000945 | chr2:68,542,833-68,542,986 | cannabinoid receptor interacting protein 1 |
| COPS7B | NM_001282950 | chr2:232655806-232655883 | COP9 signalosome subunit 7B |
| CPSF4 | NM_006693 | chr7:99045396-99045536 | cleavage and polyadenylation specific factor 4, 30 kDa |
| CRISPLD2 | NM_031476 | chr16:84869783-84870041 | cysteine-rich secretory protein LCCL domain containing 2 |
| CRYBG3 | NM_153605 | chr3:97635177-97635237 | beta-gamma crystallin domain containing 3 |
| CSNK1E | NM_001289912 | chr22:38766050-38765991 | casein kinase 1, epsilon |
| CSNK1G1 | NM_022048 | chr15:64575350-64575317 | casein kinase 1, gamma 1 |
| DAGLB | NM_139179 | chr7:6474651-6474425 | diacylglycerol lipase, beta |
| DCAF17 | NM_025000 | chr2:172298369-172298546 | DDB1 and CUL4 associated factor 17 |
| DCAF17 | NM_025000 | chr2:172309926-172309987 | DDB1 and CUL4 associated factor 17 |
| DCUN1D4 | NM_001040402 | chr4:52775086-52775141 | DCN1, defective in cullin neddylation 1, domain containing 4 |
| DDX42 | NM_007372 | chr17:61883354-61883511 | DEAD (Asp-Glu-Ala-Asp) box helicase 42 |
| DENND1A | NM_020946 | chr9:126385380-126385322 | DENN/MADD domain containing 1A |
| DENND5A | NM_015213 | chr11:9227781-9227736 | DENN/MADD domain containing 5A |
| DENND5A | NM_015213 | chr11:9198449-9198319 | DENN/MADD domain containing 5A |
| DGKA | NM_201445 | chr12:56333603-56333699 | diacylglycerol kinase, alpha 80 kDa |
| DHFR | NM_000791 | chr5:79929807-79929696 | dihydrofolate reductase |
| DHFR | NM_000791 | chr5:79928121-79928051 | dihydrofolate reductase |
| DIAPH3 | NM_001042517 | chr13:60266972-60266851 | diaphanous-related formin 3 |
| DIAPH3 | NM_001042517 | chr13:60548266-60548219 | diaphanous-related formin 3 |
| DLGAP4 | NM_014902 | chr20:35127645-35127724 | discs, large (Drosophila) homolog-associated protein 4 |
| DNAJC13 | NM_015268 | chr3:132227720-132227883 | DnaJ (Hsp40) homolog, subfamily C, member 13 |
| DNMBP | NM_015221 | chr10:101762780-101762699 | dynamin binding protein |
| DNMBP | NM_015221 | chr10:101654399-101654318 | dynamin binding protein |
| DOCK1 | NM_001380 | chr10:128901890-128901944 | dedicator of cytokinesis 1 |
| DYRK1A | NM_101395 | chr21:38794884-38794954 | dual-specificity tyrosine-(Y)-phosphorylation regulated kinase 1A |
| EIF2B3 | NM_020365 | chr1:45350395-45350311 | eukaryotic translation initiation factor 2B, subunit 3 gamma, 58 kDa |
| ENAH | NM_001008493 | chr1:225788060-225787910 | enabled homolog (Drosophila) |
| ENOX1 | NM_017993 | chr13:43,984,307-43,984,398 | ecto-NOX disulfide-thiol exchanger 1 |
| EP300 | NM_001429 | chr22:41496302-41496407 | E1A binding protein p300 |
| ERC1 | NR_027948 | chr12:1536281-1536343 | ELKS/RAB6-interacting/CAST family member 1 |
| ERCC1 | NM_001983 | chr19:45917292-45917221 | excision repair cross-complementation group 1 |
| ERGIC3 | NM_198398 | chr20:34142143-34142157 | ERGIC and golgi 3 |
| ERLIN2 | NM_007175 | chr8:37594849-37594946 | ER lipid raft associated 2 |
| ERRFI1 | NM_018948 | chr1:8,080,640-8,080,926 | ERBB receptor feedback inhibitor 1 |
| EVC | NM_153717 | chr4:5743061-5743168 | Ellis van Creveld protein |
| FAF1 | NM_007051 | chr1:51003153-51003085 | Fas (TNFRSF6) associated factor 1 |
| FAIM | NM_001033030 | chr3:138335412-138335506 | Fas apoptotic inhibitory molecule |
| FAM126A | NM_032581 | chr7:23011932-23011871 | family with sequence similarity 126, member A |
| FAM13A | NM_014883 | chr4:89890343-89890310 | family with sequence similarity 13, member A |
| FAM162A | NM_014367 | chr3:122120223-122120382 | family with sequence similarity 162, member A |
| FAM174A | NM_198507 | chr5:99917051-99917108 | family with sequence similarity 174, member A |
| FAM198B | NM_001031700 | chr4:159091499-159091399 | family with sequence similarity 198, member B |
| FBN2 | NM_001999 | chr5:127850450-127850370 | fibrillin 2 |
| FER | NM_005246 | chr5:108321155-108321188 | fer (fps/fes related) tyrosine kinase |
| FHOD3 | NM_001281740 | chr18:34322340-34322431 | formin homology 2 domain containing 3 |
| FOCAD | NM_017794 | chr9:20737106-20737152 | focadhesin |
| GALC | NM_001201402 | chr14:88447791-88447758 | galactosylceramidase |
| GCFC2 | NM_003203 | chr2:75913102-75913000 | GC-rich sequence DNA-binding factor 2 |
| GGACT | NM_001195087 | chr13:101194723-101194628 | gamma-glutamylamine cyclotransferase |
| GGCT | NM_001199815 | chr7:30540297-30540152 | gamma-glutamylcyclo-transferase |
| GLCE | NM_015554 | chr15:69517534-69517591 | glucuronic acid epimerase |
| GOLGA4 | NM_002078 | chr3:37285619-37285734 | golgin A4 |
| GOLGB1 | NM_001256486 | chr3:121401810-121401764 | golgin B1 |
| GPSM2 | NM_013296 | chr1:109420153-109420396 | G-protein signaling modulator 2 |
| GULP1 | NM_001252668 | chr2:189164835-189164866 | GULP, engulfment adaptor PTB domain containing 1 |
| GXYLT1 | NM_173601 | chr12:42489016-42488953 | glucoside xylosyltransferase 1 |
| HAT1 | NM_003642 | chr2:172803228-172803303 | histone acetyltransferase 1 |
| HDX | NM_001177479 | chrX:83756519-83756437 | highly divergent homeobox |

TABLE 11-continued

| Gene Symbol | Ref SeqID | Coordinates | Description |
|---|---|---|---|
| HLTF | NM_139048 | chr3:148769931-148769832 | helicase-like transcription factor |
| HMGA2 | NM_003483 | chr12:66267911-66267926 | high mobility group AT-hook 2 |
| HNMT | NM_006895 | chr2:138724667-138724956 | histamine N-methyltransferase |
| HPS1 | NM_000195 | chr10:100195171-100195029 | Hermansky-Pudlak syndrome 1 |
| HSD17B12 | NM_016142 | chr11:43838189-43838222 | hydroxysteroid (17-beta) dehydrogenase 12 |
| HSD17B4 | NM_001199291 | chr5:118792986-118793063 | hydroxysteroid (17-beta) dehydrogenase 4 |
| HTT | NM_002111 | chr4:3215349-3215463 | huntingtin |
| IFT57 | NM_018010 | chr3:107911373-107911323 | intraflagellar transport 57 |
| INPP5K | NM_001135642 | chr17:1419412-1419182 | inositol polyphosphate-5-phosphatase K |
| IVD | NM_002225 | chr15:40706629-40706723 | isovaleryl-CoA dehydrogenase |
| KDM6A | NM_021140 | chrX:44965787-44965894 | lysine (K)-specific demethylase 6A |
| KIAA1524 | NM_020890 | chr3:108284925-108284745 | KIAA1524 |
| KIAA1715 | NM_030650 | chr2:176835145-176834927 | KIAA1715 |
| LETM2 | NM_001286787 | chr8:38262801-38262912 | leucine zipper-EF-hand containing transmembrane protein 2 |
| LOC400927 | NR_002821 | chr22:38766050-38765991 | TPTE and PTEN homologous inositol lipid phosphatase pseudogene |
| LRRC42 | NM_001256409 | chr1:54413535-54413654 | leucine rich repeat containing 42 |
| LUC7L3 | NM_006107 | chr17:48798190-48798241 | LUC7-like 3 pre-mRNA splicing factor |
| LYRM1 | NM_001128301 | chr16:20922505-20922586 | LYR motif containing 1 |
| MADD | NM_003682 | chr11:47314094-47314147 | MAP-kinase activating death domain |
| MB21D2 | NM_178496 | chr3:192555098-192555020 | Mab-21 domain containing 2 |
| MCM10 | NM_182751 | chr10:13239941-13240039 | minichromosome maintenance complex component 10 |
| MED13L | NM_015335 | chr12:116547674-116547579 | mediator complex subunit 13-like |
| MED13L | NM_015335 | chr12:116419435-116419344 | mediator complex subunit 13-like |
| MEDAG | NM_032849 | chr13:31492953-31493127 | mesenteric estrogen-dependent adipogenesis |
| MEMO1 | NM_015955 | chr2:32112156-32112104 | Methylation modifier for class I HLA |
| MFN2 | NM_014874 | chr1:12041867-12041910 | mitofusin 2 |
| MMS19 | NM_022362 | chr10:99241240-99241106 | MMS19 homolog, cytosolic iron-sulfur assembly component |
| MRPL45 | NM_032351 | chr17:36468550-36468624 | mitochondrial ribosomal protein L45 |
| MRPS28 | NM_014018 | chr8:80915355-80915234 | mitochondrial ribosomal protein S28 |
| MTERF3 | NM_001286643 | chr8:97263851-97263810 | mitochondrial transcription termination factor 3 |
| MYCBP2 | NM_015057 | chr13:77628142-77628054 | MYC binding protein 2, E3 ubiquitin protein ligase |
| MYCBP2 | NM_015057 | chr13:77692630-77692475 | MYC binding protein 2, E3 ubiquitin protein ligase |
| MYLK | NM_053025 | chr3:123459382-123459323 | myosin light chain kinase |
| MYOF | NM_013451 | chr10:95117679-95117562 | myoferlin |
| NGF | NM_002506 | chr1:115843104-115843018 | nerve growth factor (beta polypeptide) |
| NREP | NM_001142476 | chr5:111086122-111086049 | neuronal regeneration related protein |
| NSUN4 | NR_045789 | chr1:46823248-46823331 | NOP2/Sun domain family, member 4 |
| NT5C2 | NM_012229 | chr10:104853974-104853926 | 5'-nucleotidase, cytosolic II |
| OSMR | NM_003999 | chr5:38876877-38876923 | oncostatin M receptor |
| OXCT1 | NM_000436 | chr5:41734751-41734677 | 3-oxoacid CoA transferase 1 |
| PAPD4 | NM_173797 | chr5:78937278-78937340 | PAP associated domain containing 4 |
| PCM1 | NM_006197 | chr8:17818551-17818653 | pericentriolar material 1 |
| PDE7A | NM_001242318 | chr8:66693182-66693079 | phosphodiesterase 7A |
| PDS5B | NM_015032 | chr13:33263018-33263158 | PDS5 cohesin associated factor B |
| PDXDC1 | NM_001285447 | chr16:15103356-15103418 | pyridoxal-dependent decarboxylase domain containing 1 |
| PIGN | NM_176787 | chr18:59764997-59764914 | phosphatidylinositol glycan anchor biosynthesis, class N |
| PIK3CD | NM_005026 | chr1:9774095-9774189 | phosphatidylinositol-4,5-bisphosphate 3-kinase, catalytic subunit delta |
| PIK3R1 | NM_181523 | chr5:67538784-67538973 | phosphoinositide-3-kinase, regulatory subunit 1 (alpha) |
| PIKFYVE | NM_015040 | chr2:209176229-209176294 | phosphoinositide kinase, FYVE finger containing |
| PITPNB | NM_012399 | chr22:28288318-28288117 | phosphatidylinositol transfer protein, beta |
| PITPNB | NM_012399 | chr22:28290410-28290364 | phosphatidylinositol transfer protein, beta |
| PLEKHA1 | NM_001195608 | chr10:124148798-124148900 | pleckstrin homology domain containing, family A (phosphoinositide binding specific) member 1 |
| PLSCR1 | NM_021105 | chr3:146255831-146255783 | phospholipid scramblase 1 |
| PMS1 | NM_000534 | chr2:190683464-190683555 | PMS1 homolog 1, mismatch repair system component |

TABLE 11-continued

| Gene Symbol | Ref SeqID | Coordinates | Description |
|---|---|---|---|
| POMT2 | NM_013382 | chr14:77753614-77753576 | protein-O-mannosyltransferase 2 |
| PPARG | NM_138712 | chr3:12427535-12427591 | peroxisome proliferator-activated receptor gamma |
| PPHLN1 | NM_016488 | chr12:42745687-42745851 | periphilin 1 |
| PPIP5K2 | NM_015216 | chr5:102492916-102492948 | diphosphoinositol pentakisphosphate kinase 2 |
| PPP1R26 | NM_014811 | chr9:138376071-138376135 | protein phosphatase 1, regulatory subunit 26 |
| PRPF31 | NM_015629 | chr19:54632112-54632180 | pre-mRNA processing factor 31 |
| PRSS23 | NR_120591 | chr11:86651889-86652069 | protease, serine, 23 |
| PRUNE2 | NM_015225 | chr9:79234303-79234256 | prune homolog 2 (Drosophila) |
| PSMA4 | NM_001102667 | chr15:78834921-78834987 | proteasome subunit alpha 4 |
| PXK | NM_017771 | chr3:58321084-58321179 | PX domain containing serine/threonine kinase |
| RAF1 | NM_002880 | chr3:12645036-12644977 | Raf-1 proto-oncogene, serine/threonine kinase |
| RAP1A | NM_001010935 | chr1:112170092-112170148 | RAP1A, member of RAS oncogene family |
| RAPGEF1 | NM_005312 | chr9:134479440-134479348 | Rap guanine nucleotide exchange factor (GEF) 1 |
| RARS2 | NM_020320 | chr6:88257102-88256965 | arginyl-tRNA synthetase 2, mitochondrial |
| RBKS | NM_001287580 | chr2:28111807-28111741 | ribokinase |
| RERE | NM_012102 | chr1:8456591-8456504 | arginine-glutamic acid dipeptide (RE) repeats |
| RFWD2 | NM_022457 | chr1:176044514-176044399 | ring finger and WD repeat domain 2, E3 ubiquitin protein ligase |
| RNFT1 | NM_016125 | chr17:58039977-58039901 | ring finger protein, transmembrane 1 |
| RPA1 | NM_002945 | chr17:1745069-1745127 | replication protein A1, 70 kDa |
| RPS10 | NM_001204091 | chr6:34385627-34385575 | ribosomal protein S10 |
| RPS6KB2 | NM_003952 | chr11:67196453-67196493 | ribosomal protein S6 kinase, 70 kDa, polypeptide 2 |
| SAMD4A | NM_015589 | chr14:55115465-55115566 | sterile alpha motif domain containing 4A |
| SAR1A | NM_001142648 | chr10:71926149-71926032 | secretion associated, Ras related GTPase 1A |
| SCO1 | NM_004589 | chr17:10594966-10594907 | SCO1 cytochrome c oxidase assembly protein |
| SEC24A | NM_021982 | chr5:134013731-134013842 | SEC24 homolog A, COPII coat complex component |
| SENP6 | NM_015571 | chr6:76331643-76331687 | SUMO1/sentrin specific peptidase 6 |
| SERGEF | NR_104040 | chr11:18031686-18031622 | secretion regulating guanine nucleotide exchange factor |
| SGK3 | NM_001033578 | chr8:67697924-67698031 | serum/glucocorticoid regulated kinase family, member 3 |
| SH3YL1 | NM_015677 | chr2:224920-224868 | SH3 and SYLF domain containing 1 |
| SKA2 | NM_182620 | chr17:57196856-57196757 | spindle and kinetochore associated complex subunit 2 |
| SLC12A2 | NM_001046 | chr5:127478818-127478874 | solute carrier family 12 (sodium/potassium/chloride transporter), member 2 |
| SLC25A17 | NM_006358 | chr22:41193340-41193288 | solute carrier family 25 (mitochondrial carrier; peroxisomal membrane protein, 34 kDa), member 17 |
| SLC44A2 | NM_001145056 | chr19:10753573-10753697 | solute carrier family 44 (choline transporter), member 2 |
| SMYD3 | NM_001167740 | chr1:246394576-246394501 | SET and MYND domain containing 3 |
| SNAP23 | NM_003825 | chr15:42805372-42805407 | synaptosomal-associated protein, 23 kDa |
| SNHG16 | NR_038109 | chr17:74554456-74554545 | small nucleolar RNA host gene 16 |
| SNX7 | NR_033716 | chr1:99204216-99204359 | sorting nexin 7 |
| SOS2 | NM_006939 | chr14:50600608-50600526 | son of sevenless homolog 2 (Drosophila) |
| SPATA18 | NM_145263 | chr4:52928386-52928498 | spermatogenesis associated 18 |
| SPATA5 | NM_145207 | chr4:123901321-123901384 | spermatogenesis associated 5 |
| SPIDR | NM_001080394 | chr8:48185929-48186042 | scaffolding protein involved in DNA repair |
| SPRYD7 | NM_020456 | chr13:50492357-50492229 | SPRY domain containing 7 |
| SRGAP1 | NM_020762 | chr12:64319388-64319457 | SLIT-ROBO Rho GTPase activating protein 1 |
| SRRM1 | NM_005839 | chr1:24973570-24973640 | serine/arginine repetitive matrix 1 |
| STAT1 | NM_007315 | chr2:191843332-191843254 | signal transducer and activator of transcription 1, 91 kDa |
| STRN3 | NM_001083893 | chr14:31398517-31398407 | striatin, calmodulin binding protein 3 |
| STXBP6 | NM_014178 | chr14:25411028-25410930 | syntaxin binding protein 6 (amisyn) |
| STXBP6 | NM_014178 | chr14:25457178-25457092 | syntaxin binding protein 6 (amisyn) |
| SUPT20H | NM_001014286 | chr13:37585794-37585696 | suppressor of Ty 20 homolog (S. cerevisiae) |
| TAF2 | NM_003184 | chr8:120771346-120771264 | TAF2 RNA polymerase II, TATA box binding protein (TBP)-associated factor, 150 kDa |
| TAF2 | NM_003184 | chr8:120757276-120757121 | TAF2 RNA polymerase II, TATA box binding protein (TBP)-associated factor, 150 kDa |
| TASP1 | NM_017714 | chr20:13395909-13395770 | taspase, threonine aspartase, 1 |
| TBC1D15 | NM_022771 | chr12:72278640-72278801 | TBC1 domain family, member 15 |
| TCF12 | NM_207037 | chr15:57227695-57227728 | transcription factor 12 |
| TCF4 | NM_001243226 | chr18:53202868-53202790 | transcription factor 4 |

TABLE 11-continued

| Gene Symbol | Ref SeqID | Coordinates | Description |
|---|---|---|---|
| TIAM1 | NM_003253 | chr21:32641011-32640727 | T-cell lymphoma invasion and metastasis 1 |
| TJP2 | NM_004817 | chr9:71792959-71793045 | tight junction protein 2 |
| TMEM189-UBE2V1 | NM_199203 | chr20:48713357-48713209 | TMEM189-UBE2V1 readthrough |
| TMEM214 | NM_017727 | chr2:27260130-27260168 | transmembrane protein 214 |
| TNRC6A | NM_014494 | chr16:24769760-24769920 | trinucleotide repeat containing 6A |
| TMC3 | NR_120365 | chr15:81633491-81633560 | transmembrane channel like 3 |
| TNS3 | NM_022748 | chr7:47337036-47336903 | tensin 3 |
| TOE1 | NM_025077 | chr1:45807382-45807415 | target of EGR1, member 1 (nuclear) |
| TRAF3 | NM_145725 | chr14:103356688-103356763 | TNF receptor-associated factor 3 |
| TRIM65 | NM_173547 | chr17:73887959-73887894 | tripartite motif containing 65 |
| TSPAN2 | NM_005725 | chr1:115601892-115601858 | tetraspanin 2 |
| TTC7B | NM_001010854 | chr14:91171677-91171544 | tetratricopeptide repeat domain 7B |
| TUBE1 | NM_016262 | chr6:112405449-112405392 | tubulin, epsilon 1 |
| TYW5 | NR_004862 | chr2:200813345-200813295 | tRNA-yW synthesizing protein 5 |
| UBAP2L | NM_001287816 | chr1:154234649-154234678 | ubiquitin associated protein 2-like |
| UBE2V1 | NM_199144 | chr20:48713357-48713209 | ubiquitin-conjugating enzyme E2 variant 1 |
| URGCP | NM_001077664 | chr7:43945050-43944971 | upregulator of cell proliferation |
| VAV2 | NM_001134398 | chr9:136698500-136698469 | vav 2 guanine nucleotide exchange factor |
| VPS29 | NM_057180 | chr12:110937351-110937340 | VPS29 retromer complex component |
| WDR27 | NM_182552 | chr6:170087077-170087013 | WD repeat domain 27 |
| WDR27 | NM_182552 | chr6:170061846-170061799 | WD repeat domain 27 |
| WDR37 | NM_014023 | chr10:1148398-1148517 | WD repeat domain 37 |
| WDR91 | NM_014149 | chr7:134890341-134890209 | WD repeat domain 91 |
| WNK1 | NM_018979 | chr12:1004327-1004362 | WNK lysine deficient protein kinase 1 |
| XRN2 | NM_012255 | chr20:21307793-21307903 | 5'-3' exoribonuclease 2 |
| XRN2 | NM_012255 | chr20:21326472-21326525 | 5'-3' exoribonuclease 2 |
| ZCCHC8 | NM_017612 | chr12:122963343-122963211 | zinc finger, CCHC domain containing 8 |
| ZFP82 | NM_133466 | chr19:36891305-36891187 | ZFP82 zinc finger protein |
| ZNF138 | NM_001160183 | chr7:64277652-64277713 | zinc finger protein 138 |
| ZNF232 | NM_014519 | chr17:5012080-5012041 | zinc finger protein 232 |
| ZNF37BP | NR_026777 | chr10:43046910-43046848 | zinc finger protein 37B, pseudogene |
| ZNF680 | NM_178558 | chr7:64002295-64002108 | zinc finger protein 680 |

The sequences for iExons produced in certain affected genes at the indicated coordinates from Table 11 are shown in Table 12. In certain instances, detection and analysis of the amount and type of iExon sequences are useful biomarkers produced as a result of contacting a cell with a compound as described herein or administering to a subject in need thereof a compound as described herein.

TABLE 12

| Gene Symbol | Coordinates | Sequence |
|---|---|---|
| ABCC3 | chr17:48767318-48767437 | GGCCCATAGGAAGGACGCAAAGGCCTGTGTGTGCAGGCCAGAAAAAGGCTATCCACACAGGGTGGCCAGGACACTTTCTCCTGTAAGGAAGGGATGCACCAGCCAGGCCTGAAAGAATGA (SEQ ID NO: 3695) |
| ADCY3 | chr2:25061781-25061716 | CGGATCAAAGATTGAAGAAAGATTGTACTCCTGTGTCGTGGCTCCAACACTGAGGCTGAGATGGGA (SEQ ID NO: 3696) |
| AGPAT4 | chr6:161687802-161687740 | GATACTGCAGCCATCAGCAGACAATCAATGCAATCATCTCAGACTGTGTCCTGCGTCCAGGA (SEQ ID NO: 3697) |
| ANKRA2 | chr5:72851082-72850950 | AAGTACTGTCAGCTTTGAAGGAGAAGGCTTCATGGAGGAGCTGTGACTTGACTCCAGAGTGAAAGGATAATTAGGATTGATACAGGACGGAGGAAGGAAGGCATCCAGGCAATCTCAATAAAAGCATCCATGA (SEQ ID NO: 3698) |
| ANXA11 | chr10:81916254-81916134 | AGTATCTCCTGCATGCCAGCAAGCTATGGACATCTGGAAGAAGCCACATGCCTTGCCCTCAAGTTGCTTAGGGTGGAAGGAAATGATTAGAAATGAGCCAAGCCGAGCCTGCACTCTTAGA (SEQ ID NO: 3699) |
| APIP | chr11:34933660-34933520 | CTCTGAAATTAAATCCCTACTGACTGGCCCTTGAACTGATTTTTTCTAACATCAGCAAAAGTCAAGGAGTGTTTCCCTAAAAAAGAAAGCATTTACTCAGAAACCGTATATTGAAGTCCAGGCTGAAAAATGCAAACATGA (SEQ ID NO: 3700) |
| APPL2 | chr12:105625422-105625147 | TCAGGGCTGTACGCTGTGGACCAAAGATCATGCTCGCTGATGAGAGCCACCCTGCTGGTGACCTCAGTGCTGCCGACCCATTTACATCCCAGCCCTGCCACATTCCTACAGTGGGAGGTTGAACACATTTCTTAACCTTGATGAGCCTCAGTTTCATCATC |

TABLE 12-continued

| Gene Symbol | Coordinates | Sequence |
|---|---|---|
| | | AGTAAAATGAAGTTAATGGAACCATGGAATCTACCTTGGA GAGTTGCTAGAAGAATTAAATGAAGTCACATATGTTTAGT GCCCAGCACAGCGTCCAGCACATAGGTGGTACAGA (SEQ ID NO: 3701) |
| ARHGAP1 | chr11:46718619-46718571 | GGCCGTCAACCTTTCCACCTTGAAACTGGTGTCAGGAGCA CCCTGCAGA (SEQ ID NO: 3702) |
| ASAP1 | chr8:131173039-131173031 | GTTGTTGCAGCTGCGCACCTGCTCTGTGAAGCACAGATTG TCATGGGGCAGTTCTCTCAAAAACATGGCATATTGTGAT GA (SEQ ID NO: 3703) |
| ASAP1 | chr8:131135828-131135650 | AGCAAACCCCATTGTCAGGGGAAAGCAGAACAAAGAAAA GTATTTAGAAATGTATTTCCGGGATGCACAGATTCTTTTCA CCCTCACCTTCCCCTAGGTTGTTGCAGCTGCGCACCTGCTC TGTGAAGCACAGATTGTCATGGGGGCAGTTCTCTCAAAAA CATGGCATATTGTGATGA (SEQ ID NO: 3704) |
| ASAP1 | chr8:131135731-131135650 | TCTAGGAGA (SEQ ID NO: 3705) |
| ASAP1 | chr8:131173046-131173031 | ATCGAAGTCTAGGAGA (SEQ ID NO: 3706) |
| ASPH | chr8:62,421,470-62,421,527 | TCATTCTGATCTACTGAAATTCCCCAGTTCAGACTCCATTG AAAGCCCTGGGATGGCA (SEQ ID NO: 3707) |
| ATAD2B | chr2:23976387-23976214 | GTCATCTGAGCAAATGTAATCACTCATCTACCCACAAAAT GGCTAAATGACTTAATTCAACTCCCTTTGTTGATTTGCCTG TTAGTTTGTTTATCTGGTGGTCTATCTATTAAATGTTTATTG AGTACCTGCAGTGCCAGATGCTGTGCTGGGTGTTTGGAAT GCAAAAAATGA (SEQ ID NO: 3708) |
| ATXN1 | chr6:16409524-16409426 | TTTCATAAAGAGGACAGACGCTAAGGCAATTGTGTGGAAC AGAGCAGCTTCTCGGGGTAACCATCTCCTGCTGATGTATA AATATCGGGGCAAAACTGA (SEQ ID NO: 3709) |
| BECN1 | chr17:40963348-40963310 | GATCCCATTGATGGATGGAAACTCTAGTTTTTACTTAGA (SEQ ID NO: 3710) |
| BHMT2 | chr5:78374568-78374655 | GATGTTTTCATCTGGCCCAAGAAGAACTTGTTCTTAATGTT AAAAGACCTTTTTGCTAAACTGGGAAGAAAGTGCTGGAAT AACAAGA (SEQ ID NO: 3711) |
| BICD1 | chr12:32486172-32486263 | GTCAATTTCTGCCTTGTGGATAATTTTCTGAATCTGTAATA TTTCTGAAGATTCCTCCAAGTATTTACAGAACATACAGAA GTATTTTATGA (SEQ ID NO: 3712) |
| BTN3A1 | chr6:26404363-26404455 | ATCTTGTTCTCAGAGGCCATTCCCAGACCCACAGCAAGAG GGATTATGGCTGCAGGCCTCATGCTCCTTTGTTTTGGAAGA AACTGTTGAGGA (SEQ ID NO: 3713) |
| C11orf30 | chr11:76259972-76260061 | GCCTTGTTCAAAGCTCTGGGCATCTAGCAATGAGTAAGAT AGTCAAGATCTGTGCTCTGTCCACGTTCTCTTGGAGCTTAC ATTTTAAGA (SEQ ID NO: 3714) |
| C11orf73 | chr11:86037555-86037718 | GTAATTATTGAACATCTACTTGCTGCCTACTTTCAACATCT GCATGTGTGTGTGAATATTAAATATCACACCAAGACATTG TTCAGAGGAGACAGAATAGTGAGCTGAGATAAATGAGAA TCTCTCTATGGAAGATTAGACTGGAGCATGAACTTGAAAT ATGA (SEQ ID NO: 3715) |
| C14orf132 | chr14:96506612-96506704 | AACAAAGACAAATCCCGGATTTCTCCATCAGTCTGTGACC CTAGAGAAGACCCAGAGCTGGCTCCAGGGAAGGGCTGCG TTTGGCCTGGGAGA (SEQ ID NO: 3716) |
| C8orf88 | chr8:91990874-91990807 | TGTTCCCTTTCAACTTTCAAAACGAATATCCATGCAACACT CAGTGCATACAAAGTGGAGTTAGCAGA (SEQ ID NO: 3717) |
| CASC3 | chr17:38298307-38298353 | GAGAAAGTTTCCTGTCTTTTGGATAAACTACTAGAGATGC CATCAGA (SEQ ID NO: 3718) |
| CASP7 | chr10:115477382-115477512 | GGTTGCAGAGAGCACTGGTTGAAGCCTATCCTGAAGCTAC CTTGGTAGAGGAGTTAATTGCACCAGGAGACCTAATTTCA GAAAGGTCACAGATTATATTCCACCCTCCACAAAAGTAAC CTGGAAGATGA (SEQ ID NO: 3719) |

TABLE 12-continued

| Gene Symbol | Coordinates | Sequence |
|---|---|---|
| CCDC122 | chr13:44431087-44431054 | TAACATATTTTATTGAGGTATAATTGTCATAAGA (SEQ ID NO: 3720) |
| CDH13 | chr16:83402146-83402179 | GTTTTTTGGGAACAGGTGGTGTTTGGTTACATGA (SEQ ID NO: 3721) |
| CECR7 | chr22:17,535,915-17,535,996 | CGAGAGGAAGAGGAGAAGCATGCAGGAGTGTACATGAAA CAAGATTGGCCACGAGATGACAAATATCTGAATCCGCTGA TGA (SEQ ID NO: 3722) |
| CEP112 | chr17:63684725-63684629 | AACCAACTTCAAGATGGCTGCAGCAGTGCCAGGCATTCTG CCCAGATCTGCACTATTCGGAGGCAGAAAAGGGCTGCCAG TTTCTAGGGCCTAATGA (SEQ ID NO: 3723) |
| CMAHP | chr6:25107418-25107336 | AATGAACACTCCATGAGAGCAGGGACCTGCTTTGCCTTGT TCACCACTTTATTCCCAGTGGCTAGAACCACGTCTGACAC AGA (SEQ ID NO: 3724) |
| CNRIP1 | chr2:68,542,833-68,542,986 | GTCTTACTCTTGTCACCGAGGCTGGAGTGCAGTGGTGTGA TCATAGCTCACTGCAGCCTCAACCTCCTGGATCCAAGTGA TCCTCCTGCCTCAGCCTCCCAAGTTGCTGGCACTACAGGTG TGGTATCACCACACCCGGTTAACTAAAAAAAAT (SEQ ID NO: 3725) |
| CNRIP1 | chr2:68542975-68542840 | TTAACCGGGTGTGGTGATACCACACCTGTAGTGCCAGCAA CTTGGGAGGCTGAGGCAGGAGGATCACTTGGATCCAGGA GGTTGAGGCTGCAGTGAGCTATGATCACACCACTGCACTC CAGCCTCGGTGACAAGA (SEQ ID NO: 3726) |
| CPSF4 | chr7:99045396-99045536 | AAGAGACAGGATTTCACCGTGACAGCCAGGATGGTCTCCG TGCCAGCCAGGATGGTCTCGATCTCCTGACCTTGTGATCC GCCCACCTCGGCCTTCCAAAGTGCTGGGATTACCAGCGTG ATCCACTGCGCCCGGCCATGA (SEQ ID NO: 3727) |
| CRISPLD2 | chr16:84869783-84870041 | ATTGGGTCTTATCCCCAAGATATCTCATTATGTACATGCAA ATCAGCGGAGCATCGTCATGACACCAGGAGGACACCCCGT GACGCCGATTACCGCACTCTCAACCTCAACCCAGCGTCAG AGTTTTCTGGCATCTCTTCTTTGAGCCTGGCCGCCTGCAGC TGGAAATGCTCATATATGGTGGTGTGACTAACCTGAGAGA GAGAGATCAGGGATCCTGAGAAGTTCTGCATTCTTGGTCT GCTTCCCAGTGGGACGA (SEQ ID NO: 3728) |
| CRYBG3 | chr3:97635177-97635237 | GGCCTTTCTGTCTGGTGTGTGCAGAATGATCTGGGTCACCT CTGAGGCCCATATTTATAGA (SEQ ID NO: 3729) |
| CSNK1G1 | chr15:64575350-64575317 | GTTATTGGGGTACAGATGGTGTTTGGTTACATGA (SEQ ID NO: 3730) |
| DAGLB | chr7:6474651-6474425 | TTGGATCATCATCGCTGCCACAGTGGTTTCCATTATCATTG TCTTTGACCCTCTTGGGGGGAAAATGGCTCCATATTCCTCT GCCGGCCCCAGCCACCTGGATAGTCATGATTCAAGCCAGT TACTTAATGGCCTCAAGACAGCAGCTACAAGCGTGTGGGA AACCAGAATCAAGCTCTTGTGCTGTTGCATTGGGAAAGAC GACCTATACTCGGGTTGCTTTTTCGA (SEQ ID NO: 3731) |
| DCAF17 | chr2:172298369-172298546 | TTTTGCCAAGGAGTTTGTCCACAGAGCTCTTCATGCCCTCA TGCTGGAAGTGGAAATCTGGACATGTTATCTTATCATGTC ATTATCACACCTAGGAAAATGAGCAACAATTCTTCAGGAT CATTTAATGTCAAGTTTATAACTTCCTGCTTTAACTTAAAA AAAAAATTAAATTAGA (SEQ ID NO: 3732) |
| DCUN1D4 | chr4:52775086-52775141 | GCCGAAGATGGTGTTAGTGATTGCGAGCTGCTGGCTGGCA CCCTTGCAGAGCAGGA (SEQ ID NO: 3733) |
| DDX42 | chr17:61883354-61883511 | GTGCAGTTTGAACAGGGCTTGACAGTGGCTGGACCATCAC TAAGTGAGACTTTAATTCATCAAGCATAACTGAAAATGGA GGCAGTAGATTATATCTTGGTAGCCAGCATGTGTAGACTT GTCTTATTTGGAGCCCACTTGGAATTTTCATTTCAAGA (SEQ ID NO: 3734) |
| DENND1A | chr9:126385380-126385322 | CTGTGGCATAAGAATGAAAAGAAAAGAAACAAAAGCAGA TGGCAGAGAAAACGAAAGGA (SEQ ID NO: 3735) |
| DENND5A | chr11:9227781-9227736 | GCCAAAATCATATTTATATGATCAACCTCAAGTGCATGGGA AGCTGTGAAAGTGAACATTGAACTGGGTATAATGTTACCC TGAACAGTATGAAGGTCTATGAGCAAGAAAGAAGGGGTG AATGAATTATGA (SEQ ID NO: 3736) |

TABLE 12-continued

| Gene Symbol | Coordinates | Sequence |
|---|---|---|
| DENND5A | chr11:9198449-9198319 | ATAGGACAGCATTTAAAAATCTCATGTGGAAGAATATACCACTAGA (SEQ ID NO: 3737) |
| DGKA | chr12:56333603-56333699 | ACCTGGGCCTCCCAAGCATTATCCAGCTCAGTTCCTGCCTGGCACATGGATGGTGTGGGGCAGGCATGCAGTAGCAGCTGATCTTTTAGGAGGAAGA (SEQ ID NO: 3738) |
| DIAPH3 | chr13:60266972-60266851 | GTAAATTAGACCCAAAATAACTCCCAGGGAGCAATACACAGCCTGGAAAACATGAAACAAGGAGCGGCTGTTTGGTGTAATAAAGGAGGAGCACCAGGCTGAATTTTCAGAGGCCTAATAGA (SEQ ID NO: 3739) |
| DIAPH3 | chr13:60548266-60548219 | GGTTTTGTTCCTAATGTCACATGTTTCCTAAGTAATTCAGCATAAAGA (SEQ ID NO: 3740) |
| DLGAP4 | chr20:35127645-35127724 | GAGAGGACTAGAAGGAACGGTTCCCACCTCTCGGAGGACAACGGACCCAAAGCGATCGATGTGATGGCACCCTCCTCAGA (SEQ ID NO: 3741) |
| DNAJC13 | chr3:132227720-132227883 | CCCACTGTGGAGACCTACTGCTCAGGAAAAAAGAGCTTTCAAAATACTACTGCTCGTTGGCAATGCACCTGGTCACCCAAGAGCTCCGATGGAGATGTACAAGGAGATTAATGTTTTCATGCCTGCTAATACAGCATCCATTTTGCAGCCCATGGATCAAGGA (SEQ ID NO: 3742) |
| DNMBP | chr10:101762780-101762699 | TTTGAAAATCAAATATTGAATGCAAAAGCTAGGAAGCTGTAAACAGGAAACGTAAACGAGAAAGAACAAGCAGTGAATACGA (SEQ ID NO: 3743) |
| DNMBP | chr10:101654399-101654318 | CATTGGCCAGGACTACTAGAACTGTGTCAAAACAGCTGCTACACTAACGGGCATCTTTGTCTTGTTCTCAGTCTTAAAAAGA (SEQ ID NO: 3744) |
| DOCK1 | chr10:128901890-128901944 | GAACGTTGGGGATGCAGATGACCAGTATCTAGTGCTGCGTGACTTTGGATTACGA (SEQ ID NO: 3745) |
| DYRK1A | chr21:38794884-38794954 | GTTCAGGGATGCTGGAAAGGACACTGAAGTAGGCCTTGGCTGATGGGCCTTTCAGAAGTGAACACTTAAGA (SEQ ID NO: 3746) |
| EIF2B3 | chr1:45350395-45350311 | GGAACTGACTTGTTTTCCAATGGAGGAGGAACATTTGCTGCCTACACTGGTTTGAAGCATTAAAAGGGGAGAAAAAGAGCTAAGA (SEQ ID NO: 3747) |
| ENOX1 | chr13:43,984,307-43,984,398 | TTACTCTAGAAGTCGTACTACATTTTCTGAGAGAAGTAGGAGGTGAGACGAGAGTAAGTAACTTCTGCTCTCTGAATATTTCAATTAGGCAG (SEQ ID NO: 3748) |
| ERC1 | chr12:1536281-1536343 | ACAGACCCTTCCAGAACCAGATGACCATCAAGACAAAAGCATACTCAAGCAGACAAGAAAGGA (SEQ ID NO: 3749) |
| ERCC1 | chr19:45917292-45917221 | GTGACTGAATGTCTGACCACCGTGAAGTCAGTCAACAAACGGACAGTCAGACCCTCCTGACCACATTTGGA (SEQ ID NO: 3750) |
| ERGIC3 | chr20:34142143-34142157 | TACATGCTGTGGAGA (SEQ ID NO: 3751) |
| ERLIN2 | chr8:37594849-37594946 | GGCCAAAGGAATAACTGGGAAGGTGGATGCGAGGCCAACGAATCCTACCTTGAAACTCTGCTCGCCTGCTGGCTCTGCCACTCCAGCATCTGAAAGGA (SEQ ID NO: 3752) |
| EVC | chr4:5743061-5743168 | TTCCATACAACTATCCCGCTGATTCTTTCTTCAAAGAAGCAAACCCTCCTTTGCTTTTTATATTTTCTTCACACATGGAAATGGGGGATGTGGAGGGCCTTGCACAGA (SEQ ID NO: 3753) |
| FAF1 | chr1:51003153-51003085 | TAATTTTTAACAGTGTAAAGGGGTCCTGAGACCAAAAGTTTGAGAACTGCTGCAATCAACTATAAAGA (SEQ ID NO: 3754) |
| FAIM | chr3:138335412-138335506 | GCTGGTCTCGAGTTCCTGGCTTCAAATGATTCTCCTGTCTCAGCCTCTCAAAGTGCGGGGATTACAGGGATGAGCCACCATGCACACTCCAAGGA (SEQ ID NO: 3755) |
| FAM126A | chr7:23011932-23011871 | GTCAATTTTTCTGACCACCTGAACAGATTGTTTTCTGTCAATTAAGGGCAGCTTTGTTACGA (SEQ ID NO: 3756) |

TABLE 12-continued

| Gene Symbol | Coordinates | Sequence |
|---|---|---|
| FAM13A | chr4:89890343-89890310 | GTTTTGGGGAAACAGATGGTGTTTGCTTACATGA (SEQ ID NO: 3757) |
| FAM174A | chr5:99917051-99917108 | ACTGCTGTGGAATTCCTGAGAAAGAGCAACTGAGGGATA GCAACATGGATTTCACTGA (SEQ ID NO: 3758) |
| FAM198B | chr4:159091499-159091399 | CAGCAGCAGCAGCGTGTCTTTCCATGCGCTTGGCATTCTTT ATTTTCCCAGCCTGGGAGGATATGAGAGTTCCAGGGAAAT GCTGTATTGGACATGCAAGA (SEQ ID NO: 3759) |
| FBN2 | chr5:127850450-127850370 | GATTAATTACCGTTAATGTCTTGGAGACTATAACGTACAC TGCACGTTGTAATAACACAAAAGGACAAGCAAGATGTAA GA (SEQ ID NO: 3760) |
| FER | chr5:108321155-108321188 | GTTTCTGGGGAGCAGGTGGTGTTTGCTTACATGA (SEQ ID NO: 3761) |
| FHOD3 | chr18:34322340-34322431 | GACAAAAAGCAAAGAAGAAGACTGTGGTCTAGAAGCCGA AGGAAGATGAGAAGGAAGAGTGTCCGAGGAGTCAGCCAC AGCCAGAAAGGAGA (SEQ ID NO: 3762) |
| FOCAD | chr9:20737106-20737152 | CATTGACTCCGTTATCTACACAATAAAATCTGGATCCACA GATAAGA (SEQ ID NO: 3763) |
| GALC | chr14:88447791-88447758 | GTTTTTGGAGAATAGGTGGTATTTGGTTACATGA (SEQ ID NO: 3764) |
| GCFC2 | chr2:75913102-75913000 | CAAGAGAGAAAGAGAGGAATCAAGAATGGGTCCATTGAG GAATTGGCCTGAGCAACTGGAAGGACAGAGGTGCCATTTC CTGAAAATGAAAAAGTCTGACAGGA (SEQ ID NO: 3765) |
| GGACT | chr13:101194723-101194628 | TAAGATGCTATGAGGAAATCCGTGCACGAGGGATGACAG CGTGGCAGGCTGGAACACGCTTTTTAGATTTACTTTCGTGG ACTGGATCTGTTAAGA (SEQ ID NO: 3766) |
| GLCE | chr15:69517534-69517591 | GGCAGAGGTGGAGAGGGGTTAGATTATTTCATCTGCCCTA CAGTTGGCATAATAAAGA (SEQ ID NO: 3767) |
| GOLGA4 | chr3:37285619-37285734 | GTCCAGGGATTGAAGGCTGGGGAGTAGAGCCATCCTGGGT CAGGCTGCTGGTAGGAGCGGTGGGACCTGAAAGACGTGG CGGCGTGGCCGGCGTCCAGCGCCCGAGGCTGTCACGA (SEQ ID NO: 3768) |
| GOLGB1 | chr3:121401810-121401764 | AGGTGCCTGATGCTGTTAATTCCTGAGCCTTTTGAAGATTC TGCAGA (SEQ ID NO: 3769) |
| GXYLT1 | chr12:42489016-42488953 | GGATTGTTTGTATTCCTGCCAATGATTTGTGAGACAGTCTG TTCCCCACATCCTCGTCAACAGA (SEQ ID NO: 3770) |
| HAT1 | chr2:172803228-172803303 | TTCGTTTTCCTGAAGATCTTGAAAATGACATTAGAACTTTC TTTCCTGAGTATACCCATCAACTCTTTGGGGATGA (SEQ ID NO: 3771) |
| HLTF | chr3:148769931-148769832 | TCTTGCTCTGTCGCCCAGGCTGGAGTGCAATGGCGCGATC TCAGCTCACTGCAACCTCCACCTCCCAGGTTCAAGTGATC CTGCTGCCTCAGCCTCTTGA (SEQ ID NO: 3772) |
| HMGA2 | chr12:66267911-66267926 | CTTGTTGGGAATAAGA (SEQ ID NO: 3773) |
| HNMT | chr2:138724667-138724956 | ATACCAGAATTGCTGTTAACAAATAAAATACTGGCCAGAT GTGTTGGTTCACGCCTGTAATCCTAGCACTTCGGGAGGCT GAGGCGGGAGGATTACTTGAGCCTAGGAGTTTGAGACCA GCCTGGGCAACATAGCAAGATCCCATCTCTACAAAAAAGT GAAAAAGTTAGCTGAACAAGGCGGCATGCACATGCTACTC CAGACGCTGAAGTGGGAAGATCACTTAAGTCCGAGAGAT CGAGGCTTCAGTGAGATATGGCTGAGACACTGCTCTCAGC CTGGATGACAGA (SEQ ID NO: 3774) |
| HPS1 | chr10:100195171-100195029 | TTTGGAGAATGCCTGTTCATTGCCATCAATGGTGACCACA CCGAGAGCGAGGGGGACCTGCGCGGAAGCTGTATGTGC TCAAGTACCTGTTTGAAGTGCACTTTGGGCTGGTGACTGT GGACGGTCATCTTATCCGAAAGGA (SEQ ID NO: 3775) |
| HSD17B12 | chr11:43838189-43838222 | GTTATTGGGGAACAGGTGGTGTTTGGTTACATGA (SEQ ID NO: 3776) |

TABLE 12-continued

| Gene Symbol | Coordinates | Sequence |
|---|---|---|
| HSD17B4 | chr5:118792986-118793063 | CTTTCTGACATCTTAACGAGGCAATACAGAGAGACGAATT TTCATCAGTTTGTTCAGGGAGACACATATAACAAAAGA (SEQ ID NO: 3777) |
| HTT | chr4:3215349-3215463 | AGGCAAGCCCTGGTGCTGTGGGAGCCCCAAGGAAGAGCC TCTGGCCTGGTGGCCACGTAGCCCAGGAGAGATTTCTACA GGAGCCCACAGCGCTGAAGGAGAGAGAGGCAGCAGA (SEQ ID NO: 3778) |
| IFT57 | chr3:107911373-107911323 | ATCCATACATACTTAATGCTGAAATGTGAAGGGCTGAGAA AAAAGAAAAGA (SEQ ID NO: 3779) |
| INPP5K | chr17:1419412-1419182 | CACATACATCAGGAGGTCTGCCTGATCCCATGGTGAACCC CGGGAATCCGAAATCAGATTGAGATAAGATCCTTTAGGGA AGTGACTTAGCCTGGTCTCTTGCCTGCTCTTTCACGGGGAA CAACGCTAATCGCCCACTTAGTCTAAGTCACGATGCTTGG ATTTGCTGCTAATCGTCGGATTTGAGAGTGGGAACAAGAA ATCCGGACTTTTGCTCTCCATCCTCTTAGA (SEQ ID NO: 3780) |
| IVD | chr15:40706629-40706723 | CTCTGAATGGCCTGTCTCCTGGACAAAGAAGCTTTCACGG ACTACTCTGCAGGGAGGTGACATTGGACCAGAGCTGACTC CACCTGGGGGAAAGA (SEQ ID NO: 3781) |
| KIAA1524 | chr3:108284925-108284745 | GTCAGGAATTATGGTTAAAGGTGGATTTTCACTGATGGTA ATAAGATATTACTTTATACCCCTTCCCTCCTCATGAATTAA GTCCATCTAATCTTTACTGAGGACCTGCTGAGTGGTAGAC ACTATGATTTGTTTCTGTTTCCACAGATGTCACAATTGTCA GTAATTGTGGACCTTTAGA (SEQ ID NO: 3782) |
| KIAA1715 | chr2:176835145-176834927 | TTCTCAGGTTTTCTTGACACCAAGAAAGAGAGGGAATCAA GAAGATCGGTTGTAAGAGAGCAATTCAACATGAAAATACT GAAGAAGAGATGGGAGAGAGAGAGATAATTGTTTTCT TCAGAGTTTTCCACTTTCTATCAGTAACTCTGATCACATGG ATATCTATTGTGGGGCTAGTTGATGCATCCCTTCAGATGTG TTGGAAAGAGGACCAAGA (SEQ ID NO: 3783) |
| LUC7L3 | chr17:48798190-48798241 | TGTAGGAAAGCAAGTTGGTGCTAGATGACTCCTTTTAGGA CTTTAAGAAAGA (SEQ ID NO: 3784) |
| LYRM1 | chr16:20922505-20922586 | GTGAAGTAGTATTTGAAGCTTTTCATCAGTTGGCTCATTCT TTACTCAAGAATAAACCTCAAGAAACGTCATCAGGGTCAG A (SEQ ID NO: 3785) |
| MADD | chr11:47314094-47314147 | AATTGTGGAACAAGCACCAGGAAGTGAAAAAGCAAAAG CTTTGGAAAAACAGA (SEQ ID NO: 3786) |
| MB21D2 | chr3:192555098-192555020 | GCATGTTTATGTGGGAATGTCTCTCCATGTTTACAAACTTC AGAAGGCCCCTTTGGGAAAGAAAACCTCTCAGAGAAGA (SEQ ID NO: 3787) |
| MCM10 | chr10:13239941-13240039 | TCTTGCTCTGTTGCCAGGCTAGAGTGCAGTGGCGCAGTCTT GGCTCGCTACAGCCTCTGCCTCCTGGGTTCAAGCGATCCTC CTGCCTCAGCCTCACGA (SEQ ID NO: 3788) |
| MED13L | chr12:116547674-116547579 | GTCATTTTTAACATGGATTCTTAGATGCTGACAAATATTGC CAAATTCCATTCCAAAAGAGGTTACACTTATTTCCTTTCAT CAGTGAATGA (SEQ ID NO: 3789) |
| MED13L | chr12:116419435-116419344 | CTCCTCTGAGTGTTCCTCCAAATCTGTCTTTTGGAGTAGAC CTAGAAATCATCTGTTACTAAGGTGTACTATGCATGTGGA ACCATTGATTTAAGA (SEQ ID NO: 3790) |
| MEDAG | chr13:31492953-31493127 | GAGAGGCCAGGAACAGAATGCCCAGTAACAAGAAGTGCT CATTAGAACATCTGAAGCCCACGTGTTCTTTGGCTTGATTA TAACCAGAAAGCCAGATAGTTCTTTAGGAATGTAATTCAC AGCTGTATCAAGTACACCTCCTGCACCGATCACTCAGGAG GAATCTAAAAAAGA (SEQ ID NO: 3791) |
| MEMO1 | chr2:32112156-32112104 | AAAGCGTGCTCTGGAATGGATTCACAAATGAGCTACCCTC CTTCCCTCAAAGA (SEQ ID NO: 3792) |
| MMS19 | chr10:99241240-99241106 | CATTAATTTACAGAAATACACGTATTCTCCTTGTTTTGGTG GAAGCTGCAGCTGCCAATCATCTCTCAAACCCTGTGGGTA GCTGCTAAGCTGTATTTCAGGAATGTCACAATCATACC ACTGGGGAGAAAGA (SEQ ID NO: 3793) |

TABLE 12-continued

| Gene Symbol | Coordinates | Sequence |
|---|---|---|
| MRPL45 | chr17:36468550-36468624 | GTCTGGGTGGTGGCTCATACCCGTAATCCAGCACTTTTGG AGGCCGAAGTGGGAGGATTGTTTCTGGGCAGCAGA (SEQ ID NO: 3794) |
| MRPS28 | chr8:80915355-80915234 | ATGGGACCTGCAAAGGATAAACTGGTCATTGGACGGATCT TTCATATTGTGGAGAATGATCTGTACATAGATTTTGGTGG AAAGTTTCATTGTGTATGTAGAAGACCAGAAGTGGATGGA GA (SEQ ID NO: 3795) |
| MTERF3 | chr8:97263851-97263810 | GGACGTGTCTCCGTGCTAAAGACCTAGAGATTACAACGAT GA (SEQ ID NO: 3796) |
| MYCBP2 | chr13:77628142-77628054 | GCATCTAGCATAGAACTCCCTATTCTGCATTATGACTACTG GACCACTTATCTCTCTGCCCTACTTGATAAGTTCCATGAGG ACAAAGA (SEQ ID NO: 3797) |
| MYCBP2 | chr13:77692630-77692475 | GTGACCAACTGAGTGCCATATTGAATTCCATTCAGTCACG ACCCAATCTCCCAGCTCCTTCCATCTTTGATCAAGCTGCAA AACCTCCCTCTTCCCTAGTACACAGCCCATTTGTGTTCGGA CAGCCCCTTTCCTTCCAGCAGCCTCAGCTTCAGA (SEQ ID NO: 3798) |
| MYOF | chr10:95117679-95117562 | GGTGAGAAGTTTCTGAAGGTGCTTGAACGCTCTTCTTCCA CACGAGGGCACCAAGTTGAAGCGGGAAGAACACTGAGCC ATCAGTTAGAAGGCTCAGGATATGGTCCAGTTCTAACGA (SEQ ID NO: 3799) |
| NREP | chr5:111086122-111086049 | TGTTCCAGGGCGCCATTAACGATTGGAGTTGGCACAAAAT TTGAAACTAGAAGTGGACTATTTGCTCCTTGAGA (SEQ ID NO: 3800) |
| NSUN4 | chr1:46823248-46823331 | GGGCTCAGGAGTCCAGCGGTCCTAAGTATACCTTGCAGCC ATCTTCCTAAAAGTTCTGACCATGACTGAGGACACTGAGA AGGA (SEQ ID NO: 3801) |
| NTSC2 | chr10:104853974-104853926 | AGTTTTGGTCTTAACTGAAACAGTCAAACAAACCCACTAA TTGAAAAGA (SEQ ID NO: 3802) |
| OSMR | chr5:38876877-38876923 | CTTCCTGAGAGTTTCTTGGCCTATACCCAGCTGAAGTGCA GGGAAGA (SEQ ID NO: 3803) |
| OXCT1 | chr5:41734751-41734677 | ATTTTGAAAGAAGTCTGTCTCTCAAATATTTAAAGAATCA AAATGATGTCGTATTAAAGCTTGACAAGCTAATGA (SEQ ID NO: 3804) |
| PAPD4 | chr5:78937278-78937340 | AGCTCTACCTCTGTTTTGAAATGTCATTAGTTTGGATATGT TACCAGGATGCAGCAAAGAAGA (SEQ ID NO: 3805) |
| PCM1 | chr8:17818551-17818653 | TTATGGACCAGCATTTCCATCTTTTACTGGCCTGAAATAAT ATAATAAAATCTTTAAGCCACCATAAGGATATCTAAGGAAA ATAACTGTATGTGGTTTAAAGA (SEQ ID NO: 3806) |
| PDS5B | chr13:33263018-33263158 | GCATTAGAAACATTCATATTATGAAAATACTACCTTTTTAT TCTCACTTGGTGTACTGATGTGCATTACGGTGGAGCAG TAGGCTGCAGATTTTGTGCTGCATAGCCTGAGCAGCACCG TGTTATAGTTTGACATAAGA (SEQ ID NO: 3807) |
| PIK3R1 | chr5:67538784-67538973 | TGCTCTACAAGTATAGAAAGAAGCCTTCCTCTTCCCACCG TCCCCAGACACCACATAATGGAAAAAGCAAGAATTTTCTG CATAAGCAAGGCCTTAAAAAAAAAAAAGCCAGCCTCTGA TGGGACTTCTTTCCTGCCAGAAATCCCACTGGTCCACTGTC GCAATTTTTACAAAAGGCCACGATGAAAGA (SEQ ID NO: 3808) |
| PIKFYVE | chr2:209176229-209176294 | TGGAAAGAACCTCATTTGAGCTATGCTTGGTCACAGACCT AGAGAAAGTTCACGGGGAAGTAAAGA (SEQ ID NO: 3809) |
| PITPNB | chr22:28288318-28288117 | GCGAAAATGGGCAGTGTTTACAGGCATGAATGCTGGTGGA AAGAGCAGAGTAAGGGCAGATTGCACAAGAACCGTGGAG GCCCTGGTTCCCATCACCTCCACCTCAGCACAGACTTCAG AGAGGAGAGGAGGCACTGGATGCATGACAGCAGCACTTG AGATAGGTGCTCCAGGTGGAAGGCACTGCACATGCAAAG GCTGA (SEQ ID NO: 3810) |
| PITPNB | chr22:28290410-28290364 | TGAGCTTGGAGTGAAGTCTAGTACGTCTGTGCAGCAAAGA GACCAGA (SEQ ID NO: 3811) |

TABLE 12-continued

| Gene Symbol | Coordinates | Sequence |
|---|---|---|
| PLSCR1 | chr3:146255831-146255783 | GACCACATAAACCCATTTTGAATTATTCAACCATTGCTGA ACTTCTTGA (SEQ ID NO: 3812) |
| PMS1 | chr2:190683464-190683555 | GGATTCCCCCAGCAGACGTTTTTCATCTAAGAAATGGCTT GAGTGCTTCCTTTTATCGGGTGCTGTGATAGATTCTCAAAA TATGAAAATGA (SEQ ID NO: 3813) |
| PPIP5K2 | chr5:102492916-102492948 | AACCCAACACAGATCTTAATACCATGAAAAGGA (SEQ ID NO: 3814) |
| PRSS23 | chr11:86651889-86652069 | AGCAATCTCTTTGTATTTATACAATTATGACAACAGTAGTA AGAGAAGAAGGTTCAGAGGATACAAGGTAACACACCTAC ATAAACGACCTACTGGGTACAAATATTGTAAATCAACATA GGCCTAGAAAAGGTGGTCAGATGCTGAATTTTGACTAAAT ACCTCCGATGGCACATAATGA (SEQ ID NO: 3815) |
| PRUNE2 | chr9:79234303-79234256 | AACTAGCTGCCTTTACAATGATCCAGAAATGTCTTCTATG GAGAAGGA (SEQ ID NO: 3816) |
| PSMA4 | chr15:78834921-78834987 | AGAGACGCAACATCCACAAGCTTCTTGATGAAGTCTTTTT TTCTGAAAAAATTTATAAACTCAATGA (SEQ ID NO: 3817) |
| PXK | chr3:58321084-58321179 | CTGTAAAGTTTGACTGAGAAATGTTGCATCAGCCCTGAAG TTTATTGAGAAAATCTTACGCTGATGCAAACTTTTTGGACT GTTAGTGTCTTATGA (SEQ ID NO: 3818) |
| RAF1 | chr3:12645036-12644977 | AATAACAACCTGAGTGCTTCTCCCAGGGCGTGGTCCAGAC GATTTTGTTTGAGGGGAAGA (SEQ ID NO: 3819) |
| RARS2 | chr6:88257102-88256965 | AATTGGAGAAATTAGTACTTGTGGCATAGATTGTTGTGCG GTCAGCTCTTACTGTTCTTGAGCAGCATTTTAAGAGAAGA AATGACAGGACTTGATGAAAAAGTATAAGAAATATACAG TATAAAAAAAGCTATATGA (SEQ ID NO: 3820) |
| RFWD2 | chr1:176044514-176044399 | GACTAAGATTTGAATTTATTATGTATATGAAGATCTTAAA ATTTAAGCCATTAGCTAAAGAAACTATTGGAGGAGATCTT TTATTGTATTCTGTCAGCTGTTTAACTCAGTAATGA (SEQ ID NO: 3821) |
| RNFT1 | chr17:58039977-58039901 | GAATTTCTCTTGGAATTGGGCTGCTAACAACTTTTATGTAT GCAAACAAAAGCATTGTAAATCAGGTTTTTCTAAGA (SEQ ID NO: 3822) |
| RPA1 | chr17:1745069-1745127 | ACGTCAGCTATCAGTTTAAGCATTACTTCTATGCCTAGTTT GCTGAGACTTTATAATGA (SEQ ID NO: 3823) |
| RPS6KB2 | chr11:67196453-67196493 | GACGCATGTCCCCTTGCCGAGTTGAGGGCAGCTGGCCTAG A (SEQ ID NO: 3824) |
| SAMD4A | chr14:55115465-55115566 | ATGTGATGGGAAGTCTCTGGAAGAGTTGAGAAGGAGAAT GAAGGCGCTTCATTGACCCTTGAAAATGACCACTCTGAAT GCGGCACAGAGAGTAATGAAAGA (SEQ ID NO: 3825) |
| SAR1A | chr10:71926149-71926032 | TGCATCTAAGTGGCATTCTGATTCACATTATTGATAAGACT GATTTCCTAGAGTTGTTCTTCACTGGATGACAGCAGTCGTA TGTCTAGGGAATGTGAATGAACCGCTGCCTGGAGGA (SEQ ID NO: 3826) |
| SCO1 | chr17:10594966-10594907 | AGAAAGGATTTGAACTTGGCCTTCATGTATCAACTAAGTT AATCGAGCCTTGAATTGAGA (SEQ ID NO: 3827) |
| SEC24A | chr5:134013731-134013842 | AGACCGGGTCTCTCGTTGTCACCCAGGTTAGAGTGCAGTT CCATGATCATAGCTCACTGCAGCCTTGAACTCTTGGGCTC AAGCAGTCCTCCTGCCTCAGCCTCCAGACAGA (SEQ ID NO: 3828) |
| SERGEF | chr11:18031686-18031622 | GTGTCTTCAAAAACAAACATATTTAAAAGATTTTACTTCTC ATCTCCAGGAAGAACCAGCTAGGA (SEQ ID NO: 3829) |
| SH3YL1 | chr2:224920-224868 | GTAACAGAAATGAATATAAGCTCTATCCTGGACTTTCCAG CTATCATGAGAGA (SEQ ID NO: 3830) |
| SKA2 | chr17:57196856-57196757 | AAAAATCCAGTTACACTCTTAAAGGAATTGTCAGTGATAA AGTCTCGATATCAAACTTTGTATGCCCGCTTTAAACCAGTT GCTGTTGAGCAGAAAGAGA (SEQ ID NO: 3831) |

TABLE 12-continued

| Gene Symbol | Coordinates | Sequence |
|---|---|---|
| SMYD3 | chr1:246394576-246394501 | CTATATCAGAAAAGCAGGAAACCAGAGAAAATATACCTA TTTGAAAGTGGCATGTCAGCTGGGATGAGAGAGAAGA (SEQ ID NO: 3832) |
| SNAP23 | chr15:42805372-42805407 | TATTGGAATATGACAGGGAAGATGAATTCACTATGA (SEQ ID NO: 3833) |
| SNHG16 | chr17:74554456-74554545 | AGGCCTTTCTTTGTTTGGCATCTGCAGAGACGGTGAAAAG CAGAGCTCCAGGTTGAAGGATCAGAGTAATAGATGGAGC CCTTAACATGA (SEQ ID NO: 3834) |
| SNX7 | chr1:99204216-99204359 | AGTTTGCAAAGGAAGGAAAGGAGCAGAGACTTGAATGAG CAGAAAATCATTTCAGGGCCTGTTCTCTATGTCCTTGCTAT CCCTGTCTTCTGTAGCTATTCTGAAACCATCAACAAAGGA GCACACCATTCCATCAGCAAAGA (SEQ ID NO: 3835) |
| SPATA5 | chr4:123901321-123901384 | AACCTTTATATAAATGGAATCATACTGTATACAACCTTTTG GAATTAGCTTTTTTCACATATGA (SEQ ID NO: 3836) |
| SPIDR | chr8:48185929-48186042 | GTATTCAGTAGAAGCAGATGAACAGCCAGATGAAGAGAT GGATAGAGCAAGACATGGACATTATAAAGGAATTCAATA GAAGCACATGAACGGCCAGATGAAGAGATGGATAGA (SEQ ID NO: 3837) |
| SPRYD7 | chr13:50492357-50492229 | GTGTGGTTGTACGTGCCTGTAGTCCCAGCTACTTGAGAGG CTGAGCTGAGAGGATCTCTTGAGCCGGGGAGGTCAAGTCT CCTGTGAGCAGTGATCATCGTGCCGCTGCACTCCAGCCTT GGCACCAGA (SEQ ID NO: 3838) |
| SRGAP1 | chr12:64319388-64319457 | TCACAGATACCACGTGTTAATATCTAAAGTAGAAAAAGGA ATAAAGCAAAGGAGGACAAAAAGAAAAGGA (SEQ ID NO: 3839) |
| STAT1 | chr2:191843332-191843254 | GTTTGTTATCTGCAGATCAAGGATGTGAGTCAATGTAATC TGCAACCCGTTCTTGGAAGGAATCACATTTCCCACAGGA (SEQ ID NO: 3840) |
| STXBP6 | chr14:25411028-25410930 | GTGGTCCCTGAGTTAAGAACATGCAATGGCACTCTCTCAA GGAGAGGAAGGAGCCAAAGAAGAAAGAGGTCCAAAGCA GAAAAGAGCAGACAGCTAAGA (SEQ ID NO: 3841) |
| SUPT20H | chr13:37585794-37585696 | TTGAAGACGATAATTCTAACTTCCTGTCAGTTGAAGACGA TAATTCTAACTTCCTGTCAGTTGAAGACGATAATTCTAACT TCACACTTAATTAAAAGA (SEQ ID NO: 3842) |
| TAF2 | chr8:120771346-120771264 | GAAGATGATCACCTTGCCAAGGAAGCATCATGTAATATAT CAGCTCATCAGCAGGGAGTGAAGAGGAAGTCTGATACAC CACTGGGGTCCCCACTAGAACCTGGTCAAATACTGGAGAA GAATGAGGATAGCAGTAAAGTCAAACTCAAAATCAGA (SEQ ID NO: 3843) |
| TAF2 | chr8:120757276-120757121 | TTTTGAGATCCACCAAATATGTCATTGTTGCCAGTCTTCTT TCCCAAGATGTATGGATAGTTTTTAATGTCTCATAAATATG A (SEQ ID NO: 3844) |
| TBC1D15 | chr12:72278640-72278801 | TTTGACAGACCTGAAATCAATCAAGCAAAACAAAGAGGG TATGGGCTGGTCCTATTTGGTATTCTGTCTAAAGGATGACG TCGTTCTCCCTGCTCTACACTTTCATCAAGGAGATAGCAAA CTACTGATTGAATCTCTTGAAAAATATGTGGTATTGTGTGA (SEQ ID NO: 3845) |
| TCF12 | chr15:57227695-57227728 | GTTTTTGGGGAACAGGTGGTATTTGGTGACATGA (SEQ ID NO: 3846) |
| TJP2 | chr9:71792959-71793045 | GGATTGGTGTCTCTATCATCCAGCTGGCCATTAAACAACC AAAGCTTCATCATCCTAGATAACCTGTGAGCTCTCAGAGG AGACAGA (SEQ ID NO: 3847) |
| TMEM189-UBE2V1 | chr20:48713357-48713209 | GAGTAAAAGTCCCTCGCAATTTCCGACTGTTGGAAGAACT CGAAGAAGGCCAGAAAGGAGTAGGAGATGGCACAGTTAG CTGGGGTCTAGAAGATGACGAAGACATGACACTTACAAG ATGGACAGGGATGATAATTGGGCCTCCAAGA (SEQ ID NO: 3848) |
| TMEM214 | chr2:27260130-27260168 | CCATCCTAGATCTGAGATTTGCAACCTGGAAGTTCAAGA (SEQ ID NO: 3849) |

TABLE 12-continued

| Gene Symbol | Coordinates | Sequence |
|---|---|---|
| TNS3 | chr7:47337036-47336903 | GCAGGCCCACCCATGAAACATACACGACACCACAGAGAC CTCCCTGAAGGTCCCTCAACTGCATGGACATGTAGTTCTTC CAGCCAAGCAGAGGGATCCCGGCCAGGTCCCCACTGATCC AGTTTGCAAAAGA (SEQ ID NO: 3850) |
| TOE1 | chr1:45807382-45807415 | GTTTATGGGGAACAGGTGGTGTTTGGTTAAATGA (SEQ ID NO: 3851) |
| TRAF3 | chr14:103356688-103356763 | CACCAATACATTATTATGAAGTCAGTACAGAGAGATTGGC ATCTTAGTATTTTCTGAGGAAGAGAACAGCCAAAGA (SEQ ID NO: 3852) |
| TSPAN2 | chr1:115601892-115601858 | GTTTTGTGGGGAACAGGTGGTGTTTGGTTACATGA (SEQ ID NO: 3853) |
| TUBE1 | chr6:112405449-112405392 | AGTGGTTGGTGATGGTGGAAGTATTTCCAAGGGAAAAATA TGTTCTTTAAAAGCACGA (SEQ ID NO: 3854) |
| TYW5 | chr2:200813345-200813295 | TGACAGCATGAACTGTCAGAAGCTTTGAGTTCAAGCATCT TGGGAGCAAGA (SEQ ID NO: 3855) |
| UBE2V1 | chr20:48713357-48713209 | GAGTAAAAGTCCCTCGCAATTTCCGACTGTTGGAAGAACT CGAAGAAGGCCAGAAAGGAGTAGGAGATGGCACAGTTAG CTGGGGTCTAGAAGATGACGAAGACATGACACTTACAAG ATGGACAGGGATGATAATTGGGCCTCCAAGA (SEQ ID NO: 3856) |
| URGCP | chr7:43945050-43944971 | GCTTTGGGGCAGTGGTCATTTCCGGGACCAGGCCTTTTCAT TGCCAGCTGACTACCCAGCACTTTGAGCTCATGAATAGA (SEQ ID NO: 3857) |
| XRN2 | chr20:21307793-21307903 | GTGGTTTGAATTGAGAAGGGAAGTATAGCAAAAGCTTGA GAAAGCCTTACCGTCTGGAGTTTGGACTGTATCCTATAGG CAATGAGTAGTCATGAAAATGATTTGAGAGGA (SEQ ID NO: 3858) |
| XRN2 | chr20:21326472-21326525 | CCATCAACAACTCTTAGCTGAAAGAGGGATAAGGCCCAA GCAAGGATAGAGAGA (SEQ ID NO: 3859) |
| ZNF232 | chr17:5012080-5012041 | GTGAGAGACTTTGCCTGTTTCATCACTCATAAAATTAGGA (SEQ ID NO: 3860) |
| ZNF680 | chr7:64002295-64002108 | GCAGAACTGGCCGTGAACTGTGGCTCAGGGAGCTGGAACT GAGTCATCGAACTGCTTCAGAAACCACAGTAAAGGACAA GGTCTGCAGGCCTGCCTGCGTGGCTATAAATGGCTGTCTT CCTCCAGGCCTCTGGAAGGGCACGGTCTCTCCCAGACTGT GGCTGGGAGGAGTTTGGGATGATTAGAGA (SEQ ID NO: 3861) |

Diseases or disorders associated with expression of an aberrant gene product for certain genes described herein are listed in Table 15, wherein contacting a patient cell with a compound described herein or administering to a subject in need thereof a compound described herein has been demonstrated to modulate the expression of associated RNA transcripts and are thus expected to be useful in preventing or ameliorating a disease or disorder caused by expression of an aberrant gene product.

TABLE 15

Diseases or disorders associated with expression of an aberrant gene product for certain genes.

| Gene | GeneID | Example(s) of Associated Disease or Disorder |
|---|---|---|
| ABCC3 | 8714 | Cholestasis, Colorectal Neoplasms, Peripheral Nervous System Diseases |
| ADAM17 | 6868 | Blister, Inflammatory Skin and Bowel Disease, Neonatal |
| ANXA11 | 311 | Sarcoidosis |
| APLP2 | 334 | Nerve Degeneration, Myocardial Ischemia |
| ASPH | 444 | Ectopia Lentis, Spontaneous Filtering Blebs, and Craniofacial Dysmorphism |
| ATXN1 | 6310 | Spinocerebellar Ataxia 1, Spinocerebellar Ataxias |
| AXIN1 | 8312 | Carcinoma, Hepatocellular, Caudal Duplication Anomaly |
| BECN1 | 8678 | Status Epilepticus, Colonic Neoplasms, Lewy Body Disease, Myocardial Infarction, Lung Neoplasms |
| BHMT2 | 23743 | Cleft Lip, Cleft Palate |
| C11orf30 | 56946 | Dermatitis, Atopic, Breast Neoplasms, Polycystic Ovary Syndrome |
| C11orf73 | 51501 | Stomach Neoplasms, Melanoma, Disease Progression |
| CASP7 | 840 | Myocardial Reperfusion Injury, Vitiligo, Breast Neoplasms, Leukemia, Myeloid, Acute |

TABLE 15-continued

Diseases or disorders associated with expression of an aberrant gene product for certain genes.

| Gene | GeneID | Example(s) of Associated Disease or Disorder |
|---|---|---|
| CDH13 | 1012 | Lung Neoplasms, Carcinoma, Hepatocellular, Prostatic Neoplasms, Carcinoma, Non-Small-Cell Lung, Esophageal Neoplasms, Amphetamine-Related Disorders, Substance-Related Disorders, Barrett Esophagus |
| CHEK1 | 1111 | Glomerulonephritis, IGA, Peripheral Nervous System Diseases |
| CRISPLD2 | 83716 | Neurotoxicity Syndromes, Lung Diseases, Liver Diseases |
| DCAF17 | 80067 | Woodhouse Sakati syndrome |
| DHFR | 1719 | Megaloblastic Anemia due to Dihydrofolate Reductase Deficiency, Osteosarcoma, Autistic Disorder, Folic Acid Deficiency, Neoplasm Metastasis, Colorectal Neoplasms, Nervous System Diseases, Anemia, Megaloblastic, Drug-Related Side Effects and Adverse Reactions, Metabolism, Inborn Errors, Infertility, Female, Abortion, Spontaneous, Pancytopenia |
| DIAPH3 | 81624 | Neuropathy, auditory neuropathy, benign epilepsy with centrotemporal spikes, prostate cancer, pancreatitis, prostatitis, sensorineural hearing loss |
| DENND5A | 23258 | Stomatitis |
| DNAJC13 | 23317 | Parkinson Disease |
| DOCK1 | 1793 | Substance-Related Disorders |
| DYRK1A | 1859 | Mental Retardation, Autosomal Dominant 7 |
| EIF2B3 | 8891 | Leukoencephalopathy with Vanishing White Matter, Vanishing White Matter Leukodystrophy with Ovarian Failure |
| ENAH | 55740 | Glomerulonephritis, IGA |
| EP300 | 2033 | Rubinstein-Taybi Syndrome, Endometrial Neoplasms, Carcinoma, Transitional Cell, Esophageal Squamous Cell Carcinoma, Urinary Bladder Neoplasms, Colorectal Neoplasms, Carcinoma, Adenoid Cystic, Small Cell Lung Carcinoma, Colon Carcinoma, Rubinstein-Taybi Syndrome 2 |
| ERCC1 | 2067 | Cerebrooculofacioskeletal Syndrome 4, Carcinoma, Non-Small-Cell Lung, Stomach Neoplasms, Neoplasms, Neoplasm Metastasis, Melanoma, Testicular Neoplasms, Peripheral Nervous System Diseases, Adenocarcinoma of lung, Nasopharyngeal carcinoma, Uterine Cervical Neoplasms, Arsenic Poisoning, Neoplasms, Germ Cell and Embryonal |
| ERLIN2 | 11160 | Intellectual Disability, Spastic Paraplegia 18, Autosomal Recessive |
| ERRFI1 | 54206 | Endometriosis, Polycystic Ovary Syndrome |
| EVC | 2121 | Ellis-Van Creveld Syndrome, Weyers acrofacial dysostosis |
| FAM126A | 84668 | Leukodystrophy, Hypomyelinating, 5, Substance-Related Disorders, Intellectual Disability, Peripheral Nervous System Diseases |
| FAM13A | 10144 | Pulmonary Disease, Chronic Obstructive, Idiopathic Pulmonary Fibrosis |
| FAM198B | 51313 | Glomerulonephritis, IGA |
| FBN2 | 2201 | Congenital contractural arachnodactyly, Colorectal Neoplasms |
| FHOD3 | 80206 | Substance-Related Disorders |
| GALC | 2581 | Krabbe disease, leukodystrophy, metachromatic leukodystrophy, lipid storage disease, infantile krabbe disease, chron's disease, neuropathy, neuronitis, motor neuron disease, hereditary spastic paraplegia, cerebritis, peripheral neuropathy, paraplegia, spasticity, Gaucher's disease, blindness, lysosomal storage disease, gangliosidosis, farber lipogranulomatosis, lipogranulomatosis, open-angle glaucoma, primary open angle glaucoma, glaucoma, multiple sclerosis, hepatitis, squamous cell carcinoma, hematopoietic stem cell transplantation, late-infantile or juvenile krabbe disease, adult krabbe disease |
| GGCT | 79017 | Meningioma, osteosarcoma, tuberculosis, gestational diabetes, leukemia, eczema, eczema herpeticum, myoblastoma |
| GOLGA4 | 2803 | Arsenic Poisoning, Prostatic Neoplasms, Skin Diseases |
| GPSM2 | 29899 | Chudley-Mccullough syndrome |
| GULP1 | 51454 | Thyroid Diseases |
| HLTF | 6596 | Colon cancer, adenocarcinoma, colorectal cancer, adenoma, gastric cancer, squamous cell carcinoma, cervical squamous cell carcinoma, cervical adenocarcinoma, endometrial adenocarcinoma, cervicitis, gastric cardia adenocarcinoma, cervical cancer, esophagitis, laryngeal squamous cell carcinoma, laryngitis, esophageal squamous cell carcinoma |
| HMGA2 | 8091 | Neoplasms, Lipomatosis, Multiple, Birth Weight |
| HNMT | 3176 | Asthma, Urticaria, Rhinitis, Drug Hypersensitivity, Susceptibility to Asthma |
| HPS1 | 3257 | Albinism with hemorrhagic diathesis and pigmented reticuloendothelial cells |
| HSD17B4 | 3295 | Bifunctional peroxisomal enzyme deficiency, Gonadal dysgenesis XX type deafness, Zellweger Syndrome, Peroxisomal Disorders, Spasms, Infantile |
| HTT | 3064 | Huntington Disease, Movement Disorders, Manganese Poisoning, Cadmium Poisoning |
| IVD | 3712 | Acidemia, isovaleric |
| KDM6A | 7403 | Esophageal Squamous Cell Carcinoma, Urinary Bladder Neoplasms, Neoplasms, Carcinoma, Adenoid Cystic, Carcinoma, Transitional Cell, KABUKI SYNDROME 2 |
| MED13L | 23389 | Transposition of the Great Arteries, Dextro-Looped 1, Intellectual Disability |
| MFN2 | 9927 | Charcot-Marie-Tooth Disease, Axonal, Type 2A2, Hereditary Motor And Sensory Neuropathy VI, Charcot-Marie-Tooth Disease, Cardiomegaly |
| MRPS28 | 28957 | Breast Neoplasms |
| MYLK | 4638 | Aortic Aneurysm, Familial Thoracic 7, Acute Lung Injury, Pneumonia, Neoplasm Metastasis, Glaucoma, Gastrointestinal Diseases, Vascular Diseases, Hypersensitivity, Brain Edema, Neoplasm Invasiveness, Glioma, Hypercholesterolemia |
| NGF | 4803 | Neuropathy, Hereditary Sensory And Autonomic, Type V, Inflammation, Cystitis, Hyperalgesia, Urinary Bladder, Overactive, Hereditary Sensory and Autonomic Neuropathies, Glomerulonephritis, Heroin Dependence, Peripheral Nervous System Diseases, Epilepsy, Tonic-Clonic, Hyperkinesis, Neurogenic Inflammation, Lewy Body Disease, Kidney Failure, Chronic, Nerve Degeneration, Lung Injury, Seizures, Bronchial Hyperreactivity, Nervous System Diseases, Renal Insufficiency, Chronic, Skin Ulcer, Corneal Ulcer, Parkinsonian Disorders, Neurodegenerative Diseases, Amnesia, Status Epilepticus, Parkinson Disease, Cocaine-Related Disorders, Neurobehavioral Manifestations, Nephritis, Interstitial |
| NT5C2 | 22978 | Precursor Cell Lymphoblastic Leukemia-Lymphoma, Recurrence, Spastic Paraplegia 45, Autosomal Recessive |
| OSMR | 9180 | Amyloidosis IX, Glomerulonephritis, IGA, Carcinoma, Non-Small-Cell Lung, Amyloidosis, Primary Cutaneous |

TABLE 15-continued

Diseases or disorders associated with expression of an aberrant gene product for certain genes.

| Gene | GeneID | Example(s) of Associated Disease or Disorder |
|---|---|---|
| OXCT1 | 5019 | Succinyl-CoA:3-oxoacid CoA transferase deficiency, Osteoporosis |
| PAPD4 | 167153 | Sleeping sickness |
| PCM1 | 5108 | Schizophrenia, Thyroid cancer, papillary |
| PDXDC1 | 23042 | Carcinoma, Renal Cell, Glomerulonephritis, IGA, Carboxy-lyase activity, pyridoxal phosphate binding |
| PIGN | 23556 | Multiple Congenital Anomalies-Hypotonia-Seizures Syndrome 1 |
| PIK3CD | 5293 | Activated PI3K-delta Syndrome, Lymphoma, Large B-Cell, Diffuse, Prostatic Neoplasms |
| PIK3R1 | 5295 | Short Syndrome, Insulin Resistance, Carcinoma, Mammary Neoplasms, Experimental, Burkitt Lymphoma, Mammary Neoplasms, Animal, Autosomal Recessive Agammaglobulinemia 7 |
| PIKFYVE | 200576 | Corneal Dystrophy, Fleck |
| PITPNB | 23760 | Obesity |
| PLEKHA1 | 59338 | Macular Degeneration, Age-Related, 1 |
| PLSCR1 | 5359 | Influenza, Human |
| POMT2 | 29954 | Muscular Dystrophy-Dystroglycanopathy (Limb-Girdle), Type C, 2, Muscular Dystrophy-Dystroglycanopathy (Congenital with Mental Retardation), Type B, 2, Muscular Dystrophy-Dystroglycanopathy (Congenital with Brain and Eye Anomalies), Type A, 2, Walker-Warburg Syndrome, Congenital muscular dystrophy |
| PPARG | 5468 | Obesity, Familial Partial Lipodystrophy Type 3, Hypertension, Diabetes Mellitus, Type 2, Inflammation, Acute Lung Injury, Acute Kidney Injury, Diabetes Mellitus, Experimental, Insulin Resistance, Diabetes Mellitus, Atherosclerosis, Colonic Neoplasms, Colorectal Neoplasms, Thyroid Neoplasms, Alzheimer Disease, Adenocarcinoma, Stomach Neoplasms, Dyslipidemias, Pancreatic Neoplasms, Melanoma, Lipodystrophy, Familial Partial, Crohn Disease, Metabolic Diseases, Carcinoma, Hepatocellular, Colon Carcinoma, Psoriasis, Ischemia, Reperfusion Injury, Osteoarthritis, Glioma, Liver Neoplasms, Polycystic Kidney, Autosomal Dominant, Leukostasis, Thyroid cancer, follicular, Lipidoses, Glomerulonephritis, Nerve Degeneration, Pituitary ACTH Hypersecretion, Carotid Intimal Medial Thickness 1, Barrett Esophagus, Lymphoma, T-Cell, Chronobiology Disorders, Obesity, Morbid |
| PPHLN1 | 51535 | Nervous system disorders, for example, interacts with synphilin-1, mutations of which are implicated in Parkinson's disease, gastric cancer, ichthyosis |
| PRPF31 | 26121 | Retinitis Pigmentosa 11, Retinitis Pigmentosa |
| PRS S23 | 11098 | Melanoma |
| PSMA4 | 5685 | Carcinoma, Mammary Neoplasms, Experimental, HIV Infections, Mammary Neoplasms, Animal, Liver Neoplasms |
| PXK | 54899 | Lupus Erythematosus, Systemic, Arthritis, Rheumatoid |
| RAF1 | 5894 | Noonan Syndrome 5, Noonan Syndrome, Leopard syndrome, 2, Leopard Syndrome, Glioma, Cardiomyopathy, Hypertrophic, Carcinoma, Non-Small-Cell Lung, Lung Neoplasms, Breast Neoplasms, Liver Neoplasms, Kidney Neoplasms, Cardiomyopathy, Dilated, Hyperalgesia |
| RARS2 | 57038 | Pontocerebellar Hypoplasia Type 6 |
| RFWD2 | 64326 | Autistic Disorder |
| RPA1 | 6117 | Chloracne |
| RPS10 | 6204 | Diamond-Blackfan Anemia 9 |
| RPS6KB2 | 6199 | Breast Neoplasms |
| SAMD4A | 23034 | Substance-Related Disorders |
| SCO1 | 6341 | Cytochrome-c Oxidase Deficiency, Mitochondrial Diseases |
| SLC12A2 | 6558 | Hypertension, Epilepsy, Epilepsy, Temporal Lobe, Carcinoma, Mammary Neoplasms, Experimental, Glucose Intolerance, Prostatic Neoplasms, Movement Disorders, Cardiovascular Diseases, Mammary Neoplasms, Animal |
| SMYD3 | 64754 | Amphetamine-Related Disorders |
| SNAP23 | 8773 | Myocardial Ischemia |
| SPATA5 | 166378 | Schizophrenia |
| STAT1 | 6772 | Susceptibility ToMycobacterial and Viral Infections, Autosomal Recessive, Candidiasis, Familial, 7, Arthritis, Experimental, Carcinoma, Hepatocellular, Mycobacterium Infections, Candidiasis, Chronic Mucocutaneous, Liver Cirrhosis, Arthritis, Rheumatoid, Cytomegalovirus Infections, Hearing Loss, Disease Progression, Mycobacterium Infections, Nontuberculous, Influenza, Human |
| STRN3 | 29966 | Cerebritis, cerebral cavernous malformation, cavernous malformation, cerebral cavernous malformations 3, neuronitis |
| STXBP6 | 29091 | Autistic Disorder |
| TAF2 | 6873 | Mental Retardation, Autosomal Recessive 40, Intellectual Disability |
| TCF12 | 6938 | Craniosynostosis 3, Craniosynostoses |
| TCF4 | 6925 | Pitt-Hopkins syndrome, Seizures, Peripheral Nervous System Diseases, Craniofacial Abnormalities, Heart Diseases, Microcephaly, Liver Neoplasms |
| TIAM1 | 7074 | Amyotrophic lateral sclerosis 1 |
| TJP2 | 9414 | Hypercholanemia, Familial, Hearing Loss, Cholestasis, Intrahepatic |
| TRAF3 | 7187 | Susceptibility to Herpes Simplex Encephalitis, 3 |
| VP529 | 51699 | Down syndrome, paraplegia |
| WNK1 | 65125 | Neuropathy, Hereditary Sensory and Autonomic, Type IIA, Pseudohypoaldosteronism, Type IIc, Hypertension, Kidney Diseases, Pseudohypoaldosteronism, Peripheral Nervous System Diseases |
| ZCCHC8 | 55596 | Intellectual Disability |

It will be appreciated that, although specific embodiments of the invention have been described herein for purposes of illustration, the invention described herein is not to be limited in scope by the specific embodiments herein disclosed. These embodiments are intended as illustrations of several aspects of the invention. Any equivalent embodiments are intended to be within the scope of this invention. Indeed, various modifications of the invention in addition to those shown and described herein will become apparent to those skilled in the art from the foregoing description, which modification also intended to be within the scope of this invention.

All references cited herein are incorporated herein by reference in their entirety and for all purposes to the same extent as if each individual publication or patent or patent application was specifically and individually indicated to be incorporated by reference in its entirety for all purposes.

SEQUENCE LISTING (3866 sequences)

SEQ ID NO: 1 - RNA, 10 nt, Artificial Sequence
  intronic recognition element for splicing modifier (REMS)
  misc_feature (1)..(2): n is a, c, g, or u
  misc_feature (8)..(8): n is a, c, g, or u
  misc_feature (10)..(10): n is a, c, g, or u
nngagurngn

SEQ ID NO: 2 - RNA, 8 nt, Artificial Sequence
  intronic recognition element for splicing modifier (REMS)
  misc_feature (6)..(6): n is a, c, g, or u
  misc_feature (8)..(8): n is a, c, g, or u
gagurngn

SEQ ID NO: 3 - DNA, 10 bp, Artificial Sequence
  intronic recognition element for splicing modifier (REMS)
  misc_feature (1)..(2): n is a, c, g, or t
  misc_feature (8)..(8): n is a, c, g, or t
  misc_feature (10)..(10): n is a, c, g, or t
nngagtrngn

SEQ ID NO: 4 - DNA, 8 bp, Artificial Sequence
  intronic recognition element for splicing modifier (REMS)
  misc_feature (6)..(6): n is a, c, g, or t
  misc_feature (8)..(8): n is a, c, g, or t
gagtrngn

SEQ ID NO: 5 - RNA, 4 nt, Artificial Sequence
  intronic recognition element for splicing modifier (REMS)
  misc_feature (2)..(2): n is a, c, g, or u
anga

SEQ ID NO: 6 - RNA, 4 nt, Artificial Sequence
  intronic recognition element for splicing modifier (REMS)
  misc_feature (1)..(1): n is a, c, g, or u
naga

SEQ ID NO: 7 - RNA, 4 nt, Artificial Sequence
  intronic recognition element for splicing modifier (REMS)
aaga

SEQ ID NO: 8 - RNA, 4 nt, Artificial Sequence
  intronic recognition element for splicing modifier (REMS)
caga

SEQ ID NO: 9 - RNA, 4 nt, Artificial Sequence
  intronic recognition element for splicing modifier (REMS)
gaga

SEQ ID NO: 10 - RNA, 4 nt, Artificial Sequence
  intronic recognition element for splicing modifier (REMS)
uaga

SEQ ID NO: 11 - RNA, 4 nt, Artificial Sequence
  intronic recognition element for splicing modifier (REMS)
  misc_feature (2)..(2): n is a, c, g, or u
cnga

SEQ ID NO: 12 - RNA, 4 nt, Artificial Sequence
  intronic recognition element for splicing modifier (REMS)
  misc_feature (1)..(1): n is a, c, g, or u
ncga

SEQ ID NO: 13 - RNA, 4 nt, Artificial Sequence
  intronic recognition element for splicing modifier (REMS)
acga

SEQ ID NO: 14 - RNA, 4 nt, Artificial Sequence
  intronic recognition element for splicing modifier (REMS)
ccga

SEQ ID NO: 15 - RNA, 4 nt, Artificial Sequence
  intronic recognition element for splicing modifier (REMS)
gcga

SEQ ID NO: 16 - RNA, 4 nt, Artificial Sequence
  intronic recognition element for splicing modifier (REMS)
ucga

SEQ ID NO: 17 - RNA, 4 nt, Artificial Sequence
  intronic recognition element for splicing modifier (REMS)
  misc_feature (2)..(2): n is a, c, g, or u
gnga

SEQ ID NO: 18 - RNA, 4 nt, Artificial Sequence
  intronic recognition element for splicing modifier (REMS)
  misc_feature (1)..(1): n is a, c, g, or u
ngga

SEQ ID NO: 19 - RNA, 4 nt, Artificial Sequence
  intronic recognition element for splicing modifier (REMS)
agga

SEQ ID NO: 20 - RNA, 4 nt, Artificial Sequence
  intronic recognition element for splicing modifier (REMS)
cgga

SEQ ID NO: 21 - RNA, 4 nt, Artificial Sequence
  intronic recognition element for splicing modifier (REMS)
ggga

SEQ ID NO: 22 - RNA, 4 nt, Artificial Sequence
  intronic recognition element for splicing modifier (REMS)
ugga

SEQ ID NO: 23 - RNA, 4 nt, Artificial Sequence
  intronic recognition element for splicing modifier (REMS)
  misc_feature (2)..(2): n is a, c, g, or u
unga

SEQ ID NO: 24 - RNA, 4 nt, Artificial Sequence
  intronic recognition element for splicing modifier (REMS)
  misc_feature (1)..(1): n is a, c, g, or u
nuga

SEQ ID NO: 25 - RNA, 4 nt, Artificial Sequence
  intronic recognition element for splicing modifier (REMS)
auga

SEQ ID NO: 26 - RNA, 4 nt, Artificial Sequence
  intronic recognition element for splicing modifier (REMS)
cuga

SEQ ID NO: 27 - RNA, 4 nt, Artificial Sequence
  intronic recognition element for splicing modifier (REMS)
guga

SEQ ID NO: 28 - RNA, 4 nt, Artificial Sequence
  intronic recognition element for splicing modifier (REMS)
uuga

SEQ ID NO: 29 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
angagurngn

SEQ ID NO: 30 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nagagurngn

SEQ ID NO: 31 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
aagagurngn

SEQ ID NO: 32 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cagagurngn

SEQ ID NO: 33 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gagagurngn

SEQ ID NO: 34 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uagagurngn

SEQ ID NO: 35 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
cngagurngn

SEQ ID NO: 36 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
ncgagurngn

SEQ ID NO: 37 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
acgagurngn

SEQ ID NO: 38 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
ccgagurngn

SEQ ID NO: 39 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gcgagurngn

SEQ ID NO: 40 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
ucgagurngn

SEQ ID NO: 41 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
gngagurngn

SEQ ID NO: 42 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nggagurngn

SEQ ID NO: 43 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
aggagurngn

SEQ ID NO: 44 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cggagurngn

SEQ ID NO: 45 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gggagurngn

SEQ ID NO: 46 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uggagurngn

SEQ ID NO: 47 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
ungagurngn

SEQ ID NO: 48 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nugagurngn

SEQ ID NO: 49 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
augagurngn

SEQ ID NO: 50 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cugagurngn

SEQ ID NO: 51 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gugagurngn

SEQ ID NO: 52 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uugagurngn

SEQ ID NO: 53 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angaguragn

SEQ ID NO: 54 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagaguragn

SEQ ID NO: 55 - RNA, 10 nt, Artificial Sequence
  intronic recognition element for splicing modifier (REMS)
  misc_feature (10)..(10): n is a, c, g, or u
aagaguragn

SEQ ID NO: 56 - RNA, 10 nt, Artificial Sequence
  intronic recognition element for splicing modifier (REMS)
  misc_feature (10)..(10): n is a, c, g, or u
cagaguragn

SEQ ID NO: 57 - RNA, 10 nt, Artificial Sequence
  intronic recognition element for splicing modifier (REMS)
  misc_feature (10)..(10): n is a, c, g, or u
gagaguragn

SEQ ID NO: 58 - RNA, 10 nt, Artificial Sequence
  intronic recognition element for splicing modifier (REMS)
  misc_feature (10)..(10): n is a, c, g, or u
uagaguragn

SEQ ID NO: 59 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngaguragn

SEQ ID NO: 60 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgaguragn

SEQ ID NO: 61 - RNA, 10 nt, Artificial Sequence
  intronic recognition element for splicing modifier (REMS)
  misc_feature (10)..(10): n is a, c, g, or u
acgaguragn

SEQ ID NO: 62 - RNA, 10 nt, Artificial Sequence
  intronic recognition element for splicing modifier (REMS)
  misc_feature (10)..(10): n is a, c, g, or u
ccgaguragn

SEQ ID NO: 63 - RNA, 10 nt, Artificial Sequence
  intronic recognition element for splicing modifier (REMS)
  misc_feature (10)..(10): n is a, c, g, or u
gcgaguragn

SEQ ID NO: 64 - RNA, 10 nt, Artificial Sequence
  intronic recognition element for splicing modifier (REMS)
  misc_feature (10)..(10): n is a, c, g, or u
ucgaguragn

SEQ ID NO: 65 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngaguragn

SEQ ID NO: 66 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggaguragn

SEQ ID NO: 67 - RNA, 10 nt, Artificial Sequence
  intronic recognition element for splicing modifier (REMS)
  misc_feature (10)..(10): n is a, c, g, or u
aggaguragn

SEQ ID NO: 68 - RNA, 10 nt, Artificial Sequence
  intronic recognition element for splicing modifier (REMS)
  misc_feature (10)..(10): n is a, c, g, or u
cggaguragn

SEQ ID NO: 69 - RNA, 10 nt, Artificial Sequence
  intronic recognition element for splicing modifier (REMS)
  misc_feature (10)..(10): n is a, c, g, or u
gggaguragn

SEQ ID NO: 70 - RNA, 10 nt, Artificial Sequence
  intronic recognition element for splicing modifier (REMS)
  misc_feature (10)..(10): n is a, c, g, or u
uggaguragn

SEQ ID NO: 71 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungaguragn

SEQ ID NO: 72 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugaguragn

SEQ ID NO: 73 - RNA, 10 nt, Artificial Sequence
  intronic recognition element for splicing modifier (REMS)
  misc_feature (10)..(10): n is a, c, g, or u
augaguragn

SEQ ID NO: 74 - RNA, 10 nt, Artificial Sequence
  intronic recognition element for splicing modifier (REMS)
  misc_feature (10)..(10): n is a, c, g, or u
cugaguragn

SEQ ID NO: 75 - RNA, 10 nt, Artificial Sequence
  intronic recognition element for splicing modifier (REMS)
  misc_feature (10)..(10): n is a, c, g, or u
gugaguragn

SEQ ID NO: 76 - RNA, 10 nt, Artificial Sequence
  intronic recognition element for splicing modifier (REMS)
  misc_feature (10)..(10): n is a, c, g, or u
uugaguragn

SEQ ID NO: 77 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angagurcgn

SEQ ID NO: 78 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagagurcgn

SEQ ID NO: 79 - RNA, 10 nt, Artificial Sequence
  intronic recognition element for splicing modifier (REMS)
  misc_feature (10)..(10): n is a, c, g, or u
aagagurcgn

SEQ ID NO: 80 - RNA, 10 nt, Artificial Sequence
  intronic recognition element for splicing modifier (REMS)
  misc_feature (10)..(10): n is a, c, g, or u
cagagurcgn

SEQ ID NO: 81 - RNA, 10 nt, Artificial Sequence
  intronic recognition element for splicing modifier (REMS)
  misc_feature (10)..(10): n is a, c, g, or u
gagagurcgn

SEQ ID NO: 82 - RNA, 10 nt, Artificial Sequence
  intronic recognition element for splicing modifier (REMS)
  misc_feature (10)..(10): n is a, c, g, or u
uagagurcgn

SEQ ID NO: 83 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngagurcgn

SEQ ID NO: 84 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgagurcgn

SEQ ID NO: 85 - RNA, 10 nt, Artificial Sequence
  intronic recognition element for splicing modifier (REMS)
  misc_feature (10)..(10): n is a, c, g, or u
acgagurcgn

SEQ ID NO: 86 - RNA, 10 nt, Artificial Sequence
  intronic recognition element for splicing modifier (REMS)
  misc_feature (10)..(10): n is a, c, g, or u
ccgagurcgn

SEQ ID NO: 87 - RNA, 10 nt, Artificial Sequence
  intronic recognition element for splicing modifier (REMS)
  misc_feature (10)..(10): n is a, c, g, or u
gcgagurcgn

SEQ ID NO: 88 - RNA, 10 nt, Artificial Sequence
  intronic recognition element for splicing modifier (REMS)
  misc_feature (10)..(10): n is a, c, g, or u
ucgagurcgn

SEQ ID NO: 89 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngagurcgn

SEQ ID NO: 90 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggagurcgn

SEQ ID NO: 91 - RNA, 10 nt, Artificial Sequence
  intronic recognition element for splicing modifier (REMS)
  misc_feature (10)..(10): n is a, c, g, or u
aggagurcgn

SEQ ID NO: 92 - RNA, 10 nt, Artificial Sequence
  intronic recognition element for splicing modifier (REMS)
  misc_feature (10)..(10): n is a, c, g, or u
cggagurcgn

SEQ ID NO: 93 - RNA, 10 nt, Artificial Sequence
  intronic recognition element for splicing modifier (REMS)
  misc_feature (10)..(10): n is a, c, g, or u
gggagurcgn

SEQ ID NO: 94 - RNA, 10 nt, Artificial Sequence
  intronic recognition element for splicing modifier (REMS)
  misc_feature (10)..(10): n is a, c, g, or u
uggagurcgn

SEQ ID NO: 95 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungagurcgn

SEQ ID NO: 96 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugagurcgn

SEQ ID NO: 97 - RNA, 10 nt, Artificial Sequence
  intronic recognition element for splicing modifier (REMS)
  misc_feature (10)..(10): n is a, c, g, or u
augagurcgn

SEQ ID NO: 98 - RNA, 10 nt, Artificial Sequence
  intronic recognition element for splicing modifier (REMS)
  misc_feature (10)..(10): n is a, c, g, or u
cugagurcgn

SEQ ID NO: 99 - RNA, 10 nt, Artificial Sequence
  intronic recognition element for splicing modifier (REMS)
  misc_feature (10)..(10): n is a, c, g, or u
gugagurcgn

SEQ ID NO: 100 - RNA, 10 nt, Artificial Sequence
  intronic recognition element for splicing modifier (REMS)
  misc_feature (10)..(10): n is a, c, g, or u
uugagurcgn

SEQ ID NO: 101 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angagurggn

SEQ ID NO: 102 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagagurggn

SEQ ID NO: 103 - RNA, 10 nt, Artificial Sequence
  intronic recognition element for splicing modifier (REMS)
  misc_feature (10)..(10): n is a, c, g, or u
aagagurggn

SEQ ID NO: 104 - RNA, 10 nt, Artificial Sequence
  intronic recognition element for splicing modifier (REMS)
  misc_feature (10)..(10): n is a, c, g, or u
cagagurggn

SEQ ID NO: 105 - RNA, 10 nt, Artificial Sequence
  intronic recognition element for splicing modifier (REMS)
  misc_feature (10)..(10): n is a, c, g, or u
gagagurggn

SEQ ID NO: 106 - RNA, 10 nt, Artificial Sequence
  intronic recognition element for splicing modifier (REMS)
  misc_feature (10)..(10): n is a, c, g, or u
uagagurggn

SEQ ID NO: 107 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngagurggn

SEQ ID NO: 108 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgagurggn

SEQ ID NO: 109 - RNA, 10 nt, Artificial Sequence
  intronic recognition element for splicing modifier (REMS)
  misc_feature (10)..(10): n is a, c, g, or u
acgagurggn

SEQ ID NO: 110 - RNA, 10 nt, Artificial Sequence
  intronic recognition element for splicing modifier (REMS)
  misc_feature (10)..(10): n is a, c, g, or u
ccgagurggn

SEQ ID NO: 111 - RNA, 10 nt, Artificial Sequence
  intronic recognition element for splicing modifier (REMS)
  misc_feature (10)..(10): n is a, c, g, or u
gcgagurggn

SEQ ID NO: 112 - RNA, 10 nt, Artificial Sequence
  intronic recognition element for splicing modifier (REMS)
  misc_feature (10)..(10): n is a, c, g, or u
ucgagurggn

SEQ ID NO: 113 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngagurggn

SEQ ID NO: 114 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggagurggn

SEQ ID NO: 115 - RNA, 10 nt, Artificial Sequence
  intronic recognition element for splicing modifier (REMS)
  misc_feature (10)..(10): n is a, c, g, or u
aggagurggn

SEQ ID NO: 116 - RNA, 10 nt, Artificial Sequence
  intronic recognition element for splicing modifier (REMS)
  misc_feature (10)..(10): n is a, c, g, or u
cggagurggn

SEQ ID NO: 117 - RNA, 10 nt, Artificial Sequence
  intronic recognition element for splicing modifier (REMS)
  misc_feature (10)..(10): n is a, c, g, or u
gggagurggn

SEQ ID NO: 118 - RNA, 10 nt, Artificial Sequence
  intronic recognition element for splicing modifier (REMS)
  misc_feature (10)..(10): n is a, c, g, or u
uggagurggn

SEQ ID NO: 119 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungagurggn

SEQ ID NO: 120 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugagurggn

SEQ ID NO: 121 - RNA, 10 nt, Artificial Sequence
  intronic recognition element for splicing modifier (REMS)
  misc_feature (10)..(10): n is a, c, g, or u
augagurggn

SEQ ID NO: 122 - RNA, 10 nt, Artificial Sequence
  intronic recognition element for splicing modifier (REMS)
  misc_feature (10)..(10): n is a, c, g, or u
cugagurggn

SEQ ID NO: 123 - RNA, 10 nt, Artificial Sequence
  intronic recognition element for splicing modifier (REMS)
  misc_feature (10)..(10): n is a, c, g, or u
gugagurggn

SEQ ID NO: 124 - RNA, 10 nt, Artificial Sequence
  intronic recognition element for splicing modifier (REMS)
  misc_feature (10)..(10): n is a, c, g, or u
uugagurggn

SEQ ID NO: 125 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angagurugn

SEQ ID NO: 126 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagagurugn

SEQ ID NO: 127 - RNA, 10 nt, Artificial Sequence
  intronic recognition element for splicing modifier (REMS)
  misc_feature (10)..(10): n is a, c, g, or u
aagagurugn

SEQ ID NO: 128 - RNA, 10 nt, Artificial Sequence
  intronic recognition element for splicing modifier (REMS)
  misc_feature (10)..(10): n is a, c, g, or u
cagagurugn

SEQ ID NO: 129 - RNA, 10 nt, Artificial Sequence
  intronic recognition element for splicing modifier (REMS)
  misc_feature (10)..(10): n is a, c, g, or u
gagagurugn

SEQ ID NO: 130 - RNA, 10 nt, Artificial Sequence
  intronic recognition element for splicing modifier (REMS)
  misc_feature (10)..(10): n is a, c, g, or u
uagagurugn

SEQ ID NO: 131 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngagurugn

SEQ ID NO: 132 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgagurugn

SEQ ID NO: 133 - RNA, 10 nt, Artificial Sequence
  intronic recognition element for splicing modifier (REMS)
  misc_feature (10)..(10): n is a, c, g, or u
acgagurugn

SEQ ID NO: 134 - RNA, 10 nt, Artificial Sequence
  intronic recognition element for splicing modifier (REMS)
  misc_feature (10)..(10): n is a, c, g, or u
ccgagurugn

SEQ ID NO: 135 - RNA, 10 nt, Artificial Sequence
  intronic recognition element for splicing modifier (REMS)
  misc_feature (10)..(10): n is a, c, g, or u
gcgagurugn

SEQ ID NO: 136 - RNA, 10 nt, Artificial Sequence
  intronic recognition element for splicing modifier (REMS)
  misc_feature (10)..(10): n is a, c, g, or u
ucgagurugn

SEQ ID NO: 137 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngagurugn

SEQ ID NO: 138 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggagurugn

SEQ ID NO: 139 - RNA, 10 nt, Artificial Sequence
  intronic recognition element for splicing modifier (REMS)
  misc_feature (10)..(10): n is a, c, g, or u
aggagurugn

SEQ ID NO: 140 - RNA, 10 nt, Artificial Sequence
  intronic recognition element for splicing modifier (REMS)
  misc_feature (10)..(10): n is a, c, g, or u
cggagurugn

SEQ ID NO: 141 - RNA, 10 nt, Artificial Sequence
  intronic recognition element for splicing modifier (REMS)
  misc_feature (10)..(10): n is a, c, g, or u
gggagurugn

SEQ ID NO: 142 - RNA, 10 nt, Artificial Sequence
  intronic recognition element for splicing modifier (REMS)
  misc_feature (10)..(10): n is a, c, g, or u
uggagurugn

SEQ ID NO: 143 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungagurugn

SEQ ID NO: 144 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugagurugn

SEQ ID NO: 145 - RNA, 10 nt, Artificial Sequence
  intronic recognition element for splicing modifier (REMS)
  misc_feature (10)..(10): n is a, c, g, or u
augagurugn

SEQ ID NO: 146 - RNA, 10 nt, Artificial Sequence
  intronic recognition element for splicing modifier (REMS)
  misc_feature (10)..(10): n is a, c, g, or u
cugagurugn

SEQ ID NO: 147 - RNA, 10 nt, Artificial Sequence
  intronic recognition element for splicing modifier (REMS)
  misc_feature (10)..(10): n is a, c, g, or u
gugagurugn

SEQ ID NO: 148 - RNA, 10 nt, Artificial Sequence
  intronic recognition element for splicing modifier (REMS)
  misc_feature (10)..(10): n is a, c, g, or u
uugagurugn

SEQ ID NO: 149 - RNA, 10 nt, Artificial Sequence
  intronic recognition element for splicing modifier (REMS)
  misc_feature (2)..(2): n is a, c, g, or u
angaguraga

SEQ ID NO: 150 - RNA, 10 nt, Artificial Sequence
  intronic recognition element for splicing modifier (REMS)
  misc_feature (1)..(1): n is a, c, g, or u
nagaguraga

SEQ ID NO: 151 - RNA, 10 nt, Artificial Sequence
  intronic recognition element for splicing modifier (REMS)
aagaguraga

SEQ ID NO: 152 - RNA, 10 nt, Artificial Sequence
  intronic recognition element for splicing modifier (REMS)
cagaguraga

SEQ ID NO: 153 - RNA, 10 nt, Artificial Sequence
  intronic recognition element for splicing modifier (REMS)
gagaguraga

SEQ ID NO: 154 - RNA, 10 nt, Artificial Sequence
  intronic recognition element for splicing modifier (REMS)
uagaguraga

SEQ ID NO: 155 - RNA, 10 nt, Artificial Sequence
  intronic recognition element for splicing modifier (REMS)
  misc_feature (2)..(2): n is a, c, g, or u
cngaguraga

SEQ ID NO: 156 - RNA, 10 nt, Artificial Sequence
  intronic recognition element for splicing modifier (REMS)
  misc_feature (1)..(1): n is a, c, g, or u
ncgaguraga

SEQ ID NO: 157 - RNA, 10 nt, Artificial Sequence
  intronic recognition element for splicing modifier (REMS)
acgaguraga

SEQ ID NO: 158 - RNA, 10 nt, Artificial Sequence
  intronic recognition element for splicing modifier (REMS)
ccgaguraga

SEQ ID NO: 159 - RNA, 10 nt, Artificial Sequence
  intronic recognition element for splicing modifier (REMS)
gcgaguraga

SEQ ID NO: 160 - RNA, 10 nt, Artificial Sequence
  intronic recognition element for splicing modifier (REMS)
ucgaguraga

SEQ ID NO: 161 - RNA, 10 nt, Artificial Sequence
  intronic recognition element for splicing modifier (REMS)
  misc_feature (2)..(2): n is a, c, g, or u
gngaguraga

SEQ ID NO: 162 - RNA, 10 nt, Artificial Sequence
  intronic recognition element for splicing modifier (REMS)
  misc_feature (1)..(1): n is a, c, g, or u
nggaguraga

SEQ ID NO: 163 - RNA, 10 nt, Artificial Sequence
  intronic recognition element for splicing modifier (REMS)
aggaguraga

SEQ ID NO: 164 - RNA, 10 nt, Artificial Sequence
  intronic recognition element for splicing modifier (REMS)
cggaguraga

SEQ ID NO: 165 - RNA, 10 nt, Artificial Sequence
  intronic recognition element for splicing modifier (REMS)
gggaguraga

SEQ ID NO: 166 - RNA, 10 nt, Artificial Sequence
  intronic recognition element for splicing modifier (REMS)
uggaguraga

SEQ ID NO: 167 - RNA, 10 nt, Artificial Sequence
  intronic recognition element for splicing modifier (REMS)
  misc_feature (2)..(2): n is a, c, g, or u
ungaguraga

SEQ ID NO: 168 - RNA, 10 nt, Artificial Sequence
  intronic recognition element for splicing modifier (REMS)
  misc_feature (1)..(1): n is a, c, g, or u
nugaguraga

SEQ ID NO: 169 - RNA, 10 nt, Artificial Sequence
  intronic recognition element for splicing modifier (REMS)
augaguraga

SEQ ID NO: 170 - RNA, 10 nt, Artificial Sequence
  intronic recognition element for splicing modifier (REMS)
cugaguraga

SEQ ID NO: 171 - RNA, 10 nt, Artificial Sequence
  intronic recognition element for splicing modifier (REMS)
gugaguraga

SEQ ID NO: 172 - RNA, 10 nt, Artificial Sequence
  intronic recognition element for splicing modifier (REMS)
uugaguraga

SEQ ID NO: 173 - RNA, 10 nt, Artificial Sequence
  intronic recognition element for splicing modifier (REMS)
  misc_feature (2)..(2): n is a, c, g, or u
angagurcga

SEQ ID NO: 174 - RNA, 10 nt, Artificial Sequence
  intronic recognition element for splicing modifier (REMS)
  misc_feature (1)..(1): n is a, c, g, or u
nagagurcga

SEQ ID NO: 175 - RNA, 10 nt, Artificial Sequence
  intronic recognition element for splicing modifier (REMS)
aagagurcga

SEQ ID NO: 176 - RNA, 10 nt, Artificial Sequence
  intronic recognition element for splicing modifier (REMS)
cagagurcga

SEQ ID NO: 177 - RNA, 10 nt, Artificial Sequence
  intronic recognition element for splicing modifier (REMS)
gagagurcga

SEQ ID NO: 178 - RNA, 10 nt, Artificial Sequence
  intronic recognition element for splicing modifier (REMS)
uagagurcga

SEQ ID NO: 179 - RNA, 10 nt, Artificial Sequence
  intronic recognition element for splicing modifier (REMS)
  misc_feature (2)..(2): n is a, c, g, or u
cngagurcga

SEQ ID NO: 180 - RNA, 10 nt, Artificial Sequence
  intronic recognition element for splicing modifier (REMS)
  misc_feature (1)..(1): n is a, c, g, or u
ncgagurcga

SEQ ID NO: 181 - RNA, 10 nt, Artificial Sequence
  intronic recognition element for splicing modifier (REMS)
acgagurcga

SEQ ID NO: 182 - RNA, 10 nt, Artificial Sequence
  intronic recognition element for splicing modifier (REMS)
ccgagurcga

SEQ ID NO: 183 - RNA, 10 nt, Artificial Sequence
  intronic recognition element for splicing modifier (REMS)
gcgagurcga

SEQ ID NO: 184 - RNA, 10 nt, Artificial Sequence
  intronic recognition element for splicing modifier (REMS)
ucgagurcga

SEQ ID NO: 185 - RNA, 10 nt, Artificial Sequence
  intronic recognition element for splicing modifier (REMS)
  misc_feature (2)..(2): n is a, c, g, or u
gngagurcga

SEQ ID NO: 186 - RNA, 10 nt, Artificial Sequence
  intronic recognition element for splicing modifier (REMS)
  misc_feature (1)..(1): n is a, c, g, or u
nggagurcga

SEQ ID NO: 187 - RNA, 10 nt, Artificial Sequence
  intronic recognition element for splicing modifier (REMS)
aggagurcga

SEQ ID NO: 188 - RNA, 10 nt, Artificial Sequence
  intronic recognition element for splicing modifier (REMS)
cggagurcga

SEQ ID NO: 189 - RNA, 10 nt, Artificial Sequence
  intronic recognition element for splicing modifier (REMS)
gggagurcga

SEQ ID NO: 190 - RNA, 10 nt, Artificial Sequence
  intronic recognition element for splicing modifier (REMS)
uggagurcga

SEQ ID NO: 191 - RNA, 10 nt, Artificial Sequence
  intronic recognition element for splicing modifier (REMS)
  misc_feature (2)..(2): n is a, c, g, or u
ungagurcga

SEQ ID NO: 192 - RNA, 10 nt, Artificial Sequence
  intronic recognition element for splicing modifier (REMS)
  misc_feature (1)..(1): n is a, c, g, or u
nugagurcga

SEQ ID NO: 193 - RNA, 10 nt, Artificial Sequence
  intronic recognition element for splicing modifier (REMS)
augagurcga

SEQ ID NO: 194 - RNA, 10 nt, Artificial Sequence
  intronic recognition element for splicing modifier (REMS)
cugagurcga

SEQ ID NO: 195 - RNA, 10 nt, Artificial Sequence
  intronic recognition element for splicing modifier (REMS)
gugagurcga

SEQ ID NO: 196 - RNA, 10 nt, Artificial Sequence
  intronic recognition element for splicing modifier (REMS)
uugagurcga

SEQ ID NO: 197 - RNA, 10 nt, Artificial Sequence
  intronic recognition element for splicing modifier (REMS)
  misc_feature (2)..(2): n is a, c, g, or u
angagurgga

SEQ ID NO: 198 - RNA, 10 nt, Artificial Sequence
  intronic recognition element for splicing modifier (REMS)
  misc_feature (1)..(1): n is a, c, g, or u
nagagurgga

SEQ ID NO: 199 - RNA, 10 nt, Artificial Sequence
  intronic recognition element for splicing modifier (REMS)
aagagurgga

SEQ ID NO: 200 - RNA, 10 nt, Artificial Sequence
  intronic recognition element for splicing modifier (REMS)
cagagurgga

SEQ ID NO: 201 - RNA, 10 nt, Artificial Sequence
  intronic recognition element for splicing modifier (REMS)
gagagurgga

SEQ ID NO: 202 - RNA, 10 nt, Artificial Sequence
  intronic recognition element for splicing modifier (REMS)
uagagurgga

SEQ ID NO: 203 - RNA, 10 nt, Artificial Sequence
  intronic recognition element for splicing modifier (REMS)
  misc_feature (2)..(2): n is a, c, g, or u
cngagurgga

SEQ ID NO: 204 - RNA, 10 nt, Artificial Sequence
  intronic recognition element for splicing modifier (REMS)
  misc_feature (1)..(1): n is a, c, g, or u
ncgagurgga

SEQ ID NO: 205 - RNA, 10 nt, Artificial Sequence
  intronic recognition element for splicing modifier (REMS)
acgagurgga

SEQ ID NO: 206 - RNA, 10 nt, Artificial Sequence
  intronic recognition element for splicing modifier (REMS)
ccgagurgga

SEQ ID NO: 207 - RNA, 10 nt, Artificial Sequence
  intronic recognition element for splicing modifier (REMS)
gcgagurgga

SEQ ID NO: 208 - RNA, 10 nt, Artificial Sequence
  intronic recognition element for splicing modifier (REMS)
ucgagurgga

SEQ ID NO: 209 - RNA, 10 nt, Artificial Sequence
  intronic recognition element for splicing modifier (REMS)
  misc_feature (2)..(2): n is a, c, g, or u
gngagurgga

SEQ ID NO: 210 - RNA, 10 nt, Artificial Sequence
  intronic recognition element for splicing modifier (REMS)
  misc_feature (1)..(1): n is a, c, g, or u
nggagurgga

SEQ ID NO: 211 - RNA, 10 nt, Artificial Sequence
  intronic recognition element for splicing modifier (REMS)
aggagurgga

SEQ ID NO: 212 - RNA, 10 nt, Artificial Sequence
  intronic recognition element for splicing modifier (REMS)
cggagurgga

SEQ ID NO: 213 - RNA, 10 nt, Artificial Sequence
  intronic recognition element for splicing modifier (REMS)
gggagurgga

SEQ ID NO: 214 - RNA, 10 nt, Artificial Sequence
  intronic recognition element for splicing modifier (REMS)
uggagurgga

SEQ ID NO: 215 - RNA, 10 nt, Artificial Sequence
  intronic recognition element for splicing modifier (REMS)
  misc_feature (2)..(2): n is a, c, g, or u
ungagurgga

SEQ ID NO: 216 - RNA, 10 nt, Artificial Sequence
  intronic recognition element for splicing modifier (REMS)
  misc_feature (1)..(1): n is a, c, g, or u
nugagurgga

SEQ ID NO: 217 - RNA, 10 nt, Artificial Sequence
  intronic recognition element for splicing modifier (REMS)
augagurgga

SEQ ID NO: 218 - RNA, 10 nt, Artificial Sequence
  intronic recognition element for splicing modifier (REMS)
cugagurgga

SEQ ID NO: 219 - RNA, 10 nt, Artificial Sequence
  intronic recognition element for splicing modifier (REMS)
gugagurgga

SEQ ID NO: 220 - RNA, 10 nt, Artificial Sequence
  intronic recognition element for splicing modifier (REMS)
uugagurgga

SEQ ID NO: 221 - RNA, 10 nt, Artificial Sequence
  intronic recognition element for splicing modifier (REMS)
  misc_feature (2)..(2): n is a, c, g, or u
angaguruga

SEQ ID NO: 222 - RNA, 10 nt, Artificial Sequence
  intronic recognition element for splicing modifier (REMS)
  misc_feature (1)..(1): n is a, c, g, or u
nagaguruga

SEQ ID NO: 223 - RNA, 10 nt, Artificial Sequence
  intronic recognition element for splicing modifier (REMS)
aagaguruga

SEQ ID NO: 224 - RNA, 10 nt, Artificial Sequence
  intronic recognition element for splicing modifier (REMS)
cagaguruga

SEQ ID NO: 225 - RNA, 10 nt, Artificial Sequence
  intronic recognition element for splicing modifier (REMS)
gagaguruga

SEQ ID NO: 226 - RNA, 10 nt, Artificial Sequence
  intronic recognition element for splicing modifier (REMS)
uagaguruga

SEQ ID NO: 227 - RNA, 10 nt, Artificial Sequence
  intronic recognition element for splicing modifier (REMS)
  misc_feature (2)..(2): n is a, c, g, or u
cngaguruga

SEQ ID NO: 228 - RNA, 10 nt, Artificial Sequence
  intronic recognition element for splicing modifier (REMS)
  misc_feature (1)..(1): n is a, c, g, or u
ncgaguruga

SEQ ID NO: 229 - RNA, 10 nt, Artificial Sequence
  intronic recognition element for splicing modifier (REMS)
acgaguruga

SEQ ID NO: 230 - RNA, 10 nt, Artificial Sequence
  intronic recognition element for splicing modifier (REMS)
ccgaguruga

SEQ ID NO: 231 - RNA, 10 nt, Artificial Sequence
  intronic recognition element for splicing modifier (REMS)
gcgaguruga

SEQ ID NO: 232 - RNA, 10 nt, Artificial Sequence
  intronic recognition element for splicing modifier (REMS)
ucgaguruga

SEQ ID NO: 233 - RNA, 10 nt, Artificial Sequence
  intronic recognition element for splicing modifier (REMS)
  misc_feature (2)..(2): n is a, c, g, or u
gngaguruga

SEQ ID NO: 234 - RNA, 10 nt, Artificial Sequence
  intronic recognition element for splicing modifier (REMS)
  misc_feature (1)..(1): n is a, c, g, or u
nggaguruga

SEQ ID NO: 235 - RNA, 10 nt, Artificial Sequence
  intronic recognition element for splicing modifier (REMS)
aggaguruga

SEQ ID NO: 236 - RNA, 10 nt, Artificial Sequence
  intronic recognition element for splicing modifier (REMS)
cggaguruga

SEQ ID NO: 237 - RNA, 10 nt, Artificial Sequence
  intronic recognition element for splicing modifier (REMS)
gggaguruga

SEQ ID NO: 238 - RNA, 10 nt, Artificial Sequence
  intronic recognition element for splicing modifier (REMS)
uggaguruga

SEQ ID NO: 239 - RNA, 10 nt, Artificial Sequence
  intronic recognition element for splicing modifier (REMS)
  misc_feature (2)..(2): n is a, c, g, or u
ungaguruga

SEQ ID NO: 240 - RNA, 10 nt, Artificial Sequence
  intronic recognition element for splicing modifier (REMS)
  misc_feature (1)..(1): n is a, c, g, or u
nugaguruga

SEQ ID NO: 241 - RNA, 10 nt, Artificial Sequence
  intronic recognition element for splicing modifier (REMS)
augaguruga

SEQ ID NO: 242 - RNA, 10 nt, Artificial Sequence
  intronic recognition element for splicing modifier (REMS)
cugaguruga

SEQ ID NO: 243 - RNA, 10 nt, Artificial Sequence
  intronic recognition element for splicing modifier (REMS)
gugaguruga

SEQ ID NO: 244 - RNA, 10 nt, Artificial Sequence
  intronic recognition element for splicing modifier (REMS)
uugaguruga

SEQ ID NO: 245 - RNA, 10 nt, Artificial Sequence
  intronic recognition element for splicing modifier (REMS)
  misc_feature (2)..(2): n is a, c, g, or u
angaguragc

SEQ ID NO: 246 - RNA, 10 nt, Artificial Sequence
  intronic recognition element for splicing modifier (REMS)
  misc_feature (1)..(1): n is a, c, g, or u
nagaguragc

SEQ ID NO: 247 - RNA, 10 nt, Artificial Sequence
  intronic recognition element for splicing modifier (REMS)
aagaguragc

SEQ ID NO: 248 - RNA, 10 nt, Artificial Sequence
  intronic recognition element for splicing modifier (REMS)
cagaguragc

SEQ ID NO: 249 - RNA, 10 nt, Artificial Sequence
  intronic recognition element for splicing modifier (REMS)
gagaguragc

SEQ ID NO: 250 - RNA, 10 nt, Artificial Sequence
  intronic recognition element for splicing modifier (REMS)
uagaguragc

SEQ ID NO: 251 - RNA, 10 nt, Artificial Sequence
  intronic recognition element for splicing modifier (REMS)
  misc_feature (2)..(2): n is a, c, g, or u
cngaguragc

SEQ ID NO: 252 - RNA, 10 nt, Artificial Sequence
  intronic recognition element for splicing modifier (REMS)
  misc_feature (1)..(1): n is a, c, g, or u
ncgaguragc

SEQ ID NO: 253 - RNA, 10 nt, Artificial Sequence
  intronic recognition element for splicing modifier (REMS)
acgaguragc

SEQ ID NO: 254 - RNA, 10 nt, Artificial Sequence
  intronic recognition element for splicing modifier (REMS)
ccgaguragc

SEQ ID NO: 255 - RNA, 10 nt, Artificial Sequence
  intronic recognition element for splicing modifier (REMS)
gcgaguragc

SEQ ID NO: 256 - RNA, 10 nt, Artificial Sequence
  intronic recognition element for splicing modifier (REMS)
ucgaguragc

SEQ ID NO: 257 - RNA, 10 nt, Artificial Sequence
  intronic recognition element for splicing modifier (REMS)
  misc_feature (2)..(2): n is a, c, g, or u
gngaguragc

SEQ ID NO: 258 - RNA, 10 nt, Artificial Sequence
  intronic recognition element for splicing modifier (REMS)
  misc_feature (1)..(1): n is a, c, g, or u
nggaguragc

SEQ ID NO: 259 - RNA, 10 nt, Artificial Sequence
  intronic recognition element for splicing modifier (REMS)
aggaguragc

SEQ ID NO: 260 - RNA, 10 nt, Artificial Sequence
  intronic recognition element for splicing modifier (REMS)
cggaguragc

SEQ ID NO: 261 - RNA, 10 nt, Artificial Sequence
  intronic recognition element for splicing modifier (REMS)
gggaguragc

SEQ ID NO: 262 - RNA, 10 nt, Artificial Sequence
  intronic recognition element for splicing modifier (REMS)
uggaguragc

SEQ ID NO: 263 - RNA, 10 nt, Artificial Sequence
  intronic recognition element for splicing modifier (REMS)
  misc_feature (2)..(2): n is a, c, g, or u
ungaguragc

SEQ ID NO: 264 - RNA, 10 nt, Artificial Sequence
  intronic recognition element for splicing modifier (REMS)
  misc_feature (1)..(1): n is a, c, g, or u
nugaguragc

SEQ ID NO: 265 - RNA, 10 nt, Artificial Sequence
  intronic recognition element for splicing modifier (REMS)
augaguragc

SEQ ID NO: 266 - RNA, 10 nt, Artificial Sequence
  intronic recognition element for splicing modifier (REMS)
cugaguragc

SEQ ID NO: 267 - RNA, 10 nt, Artificial Sequence
  intronic recognition element for splicing modifier (REMS)
gugaguragc

SEQ ID NO: 268 - RNA, 10 nt, Artificial Sequence
  intronic recognition element for splicing modifier (REMS)
uugaguragc

SEQ ID NO: 269 - RNA, 10 nt, Artificial Sequence
  intronic recognition element for splicing modifier (REMS)
  misc_feature (2)..(2): n is a, c, g, or u
angagurcgc

SEQ ID NO: 270 - RNA, 10 nt, Artificial Sequence
  intronic recognition element for splicing modifier (REMS)
  misc_feature (1)..(1): n is a, c, g, or u
nagagurcgc

SEQ ID NO: 271 - RNA, 10 nt, Artificial Sequence
  intronic recognition element for splicing modifier (REMS)
aagagurcgc

SEQ ID NO: 272 - RNA, 10 nt, Artificial Sequence
  intronic recognition element for splicing modifier (REMS)
cagagurcgc

SEQ ID NO: 273 - RNA, 10 nt, Artificial Sequence
  intronic recognition element for splicing modifier (REMS)
gagagurcgc

SEQ ID NO: 274 - RNA, 10 nt, Artificial Sequence
  intronic recognition element for splicing modifier (REMS)
uagagurcgc

SEQ ID NO: 275 - RNA, 10 nt, Artificial Sequence
  intronic recognition element for splicing modifier (REMS)
  misc_feature (2)..(2): n is a, c, g, or u
cngagurcgc

SEQ ID NO: 276 - RNA, 10 nt, Artificial Sequence
  intronic recognition element for splicing modifier (REMS)
  misc_feature (1)..(1): n is a, c, g, or u
ncgagurcgc

SEQ ID NO: 277 - RNA, 10 nt, Artificial Sequence
  intronic recognition element for splicing modifier (REMS)
acgagurcgc

SEQ ID NO: 278 - RNA, 10 nt, Artificial Sequence
  intronic recognition element for splicing modifier (REMS)
ccgagurcgc

SEQ ID NO: 279 - RNA, 10 nt, Artificial Sequence
  intronic recognition element for splicing modifier (REMS)
gcgagurcgc

SEQ ID NO: 280 - RNA, 10 nt, Artificial Sequence
  intronic recognition element for splicing modifier (REMS)
ucgagurcgc

SEQ ID NO: 281 - RNA, 10 nt, Artificial Sequence
  intronic recognition element for splicing modifier (REMS)
  misc_feature (2)..(2): n is a, c, g, or u
gngagurcgc

SEQ ID NO: 282 - RNA, 10 nt, Artificial Sequence
  intronic recognition element for splicing modifier (REMS)
  misc_feature (1)..(1): n is a, c, g, or u
nggagurcgc

SEQ ID NO: 283 - RNA, 10 nt, Artificial Sequence
  intronic recognition element for splicing modifier (REMS)
aggagurcgc

SEQ ID NO: 284 - RNA, 10 nt, Artificial Sequence
  intronic recognition element for splicing modifier (REMS)
cggagurcgc

SEQ ID NO: 285 - RNA, 10 nt, Artificial Sequence
  intronic recognition element for splicing modifier (REMS)
gggagurcgc

SEQ ID NO: 286 - RNA, 10 nt, Artificial Sequence
  intronic recognition element for splicing modifier (REMS)
uggagurcgc

SEQ ID NO: 287 - RNA, 10 nt, Artificial Sequence
  intronic recognition element for splicing modifier (REMS)
  misc_feature (2)..(2): n is a, c, g, or u
ungagurcgc

SEQ ID NO: 288 - RNA, 10 nt, Artificial Sequence
  intronic recognition element for splicing modifier (REMS)
  misc_feature (1)..(1): n is a, c, g, or u
nugagurcgc

SEQ ID NO: 289 - RNA, 10 nt, Artificial Sequence
  intronic recognition element for splicing modifier (REMS)
augagurcgc

SEQ ID NO: 290 - RNA, 10 nt, Artificial Sequence
  intronic recognition element for splicing modifier (REMS)
cugagurcgc

SEQ ID NO: 291 - RNA, 10 nt, Artificial Sequence
  intronic recognition element for splicing modifier (REMS)
gugagurcgc

SEQ ID NO: 292 - RNA, 10 nt, Artificial Sequence
  intronic recognition element for splicing modifier (REMS)
uugagurcgc

SEQ ID NO: 293 - RNA, 10 nt, Artificial Sequence
  intronic recognition element for splicing modifier (REMS)
  misc_feature (2)..(2): n is a, c, g, or u
angagurggc

SEQ ID NO: 294 - RNA, 10 nt, Artificial Sequence
  intronic recognition element for splicing modifier (REMS)
  misc_feature (1)..(1): n is a, c, g, or u
nagagurggc

SEQ ID NO: 295 - RNA, 10 nt, Artificial Sequence
  intronic recognition element for splicing modifier (REMS)
aagagurggc

SEQ ID NO: 296 - RNA, 10 nt, Artificial Sequence
  intronic recognition element for splicing modifier (REMS)
cagagurggc

SEQ ID NO: 297 - RNA, 10 nt, Artificial Sequence
  intronic recognition element for splicing modifier (REMS)
gagagurggc

SEQ ID NO: 298 - RNA, 10 nt, Artificial Sequence
  intronic recognition element for splicing modifier (REMS)
uagagurggc

SEQ ID NO: 299 - RNA, 10 nt, Artificial Sequence
  intronic recognition element for splicing modifier (REMS)
  misc_feature (2)..(2): n is a, c, g, or u
cngagurggc

SEQ ID NO: 300 - RNA, 10 nt, Artificial Sequence
  intronic recognition element for splicing modifier (REMS)
  misc_feature (1)..(1): n is a, c, g, or u
ncgagurggc

SEQ ID NO: 301 - RNA, 10 nt, Artificial Sequence
  intronic recognition element for splicing modifier (REMS)
acgagurggc

SEQ ID NO: 302 - RNA, 10 nt, Artificial Sequence
  intronic recognition element for splicing modifier (REMS)
ccgagurggc

SEQ ID NO: 303 - RNA, 10 nt, Artificial Sequence
  intronic recognition element for splicing modifier (REMS)
gcgagurggc

SEQ ID NO: 304 - RNA, 10 nt, Artificial Sequence
  intronic recognition element for splicing modifier (REMS)
ucgagurggc

SEQ ID NO: 305 - RNA, 10 nt, Artificial Sequence
  intronic recognition element for splicing modifier (REMS)
  misc_feature (2)..(2): n is a, c, g, or u
gngagurggc

SEQ ID NO: 306 - RNA, 10 nt, Artificial Sequence
  intronic recognition element for splicing modifier (REMS)
  misc_feature (1)..(1): n is a, c, g, or u
nggagurggc

SEQ ID NO: 307 - RNA, 10 nt, Artificial Sequence
  intronic recognition element for splicing modifier (REMS)
aggagurggc

SEQ ID NO: 308 - RNA, 10 nt, Artificial Sequence
  intronic recognition element for splicing modifier (REMS)
cggagurggc

SEQ ID NO: 309 - RNA, 10 nt, Artificial Sequence
  intronic recognition element for splicing modifier (REMS)
gggagurggc

SEQ ID NO: 310 - RNA, 10 nt, Artificial Sequence
  intronic recognition element for splicing modifier (REMS)
uggagurggc

SEQ ID NO: 311 - RNA, 10 nt, Artificial Sequence
  intronic recognition element for splicing modifier (REMS)
  misc_feature (2)..(2): n is a, c, g, or u
ungagurggc

SEQ ID NO: 312 - RNA, 10 nt, Artificial Sequence
  intronic recognition element for splicing modifier (REMS)
  misc_feature (1)..(1): n is a, c, g, or u
nugagurggc

SEQ ID NO: 313 - RNA, 10 nt, Artificial Sequence
  intronic recognition element for splicing modifier (REMS)
augagurggc

SEQ ID NO: 314 - RNA, 10 nt, Artificial Sequence
  intronic recognition element for splicing modifier (REMS)
cugagurggc

SEQ ID NO: 315 - RNA, 10 nt, Artificial Sequence
  intronic recognition element for splicing modifier (REMS)
gugagurggc

SEQ ID NO: 316 - RNA, 10 nt, Artificial Sequence
  intronic recognition element for splicing modifier (REMS)
uugagurggc

SEQ ID NO: 317 - RNA, 10 nt, Artificial Sequence
  intronic recognition element for splicing modifier (REMS)
  misc_feature (2)..(2): n is a, c, g, or u
angagurugc

SEQ ID NO: 318 - RNA, 10 nt, Artificial Sequence
  intronic recognition element for splicing modifier (REMS)
  misc_feature (1)..(1): n is a, c, g, or u
nagagurugc

SEQ ID NO: 319 - RNA, 10 nt, Artificial Sequence
  intronic recognition element for splicing modifier (REMS)
aagagurugc

SEQ ID NO: 320 - RNA, 10 nt, Artificial Sequence
  intronic recognition element for splicing modifier (REMS)
cagagurugc

SEQ ID NO: 321 - RNA, 10 nt, Artificial Sequence
  intronic recognition element for splicing modifier (REMS)
gagagurugc

SEQ ID NO: 322 - RNA, 10 nt, Artificial Sequence
  intronic recognition element for splicing modifier (REMS)
uagagurugc

SEQ ID NO: 323 - RNA, 10 nt, Artificial Sequence
  intronic recognition element for splicing modifier (REMS)
  misc_feature (2)..(2): n is a, c, g, or u
cngagurugc

SEQ ID NO: 324 - RNA, 10 nt, Artificial Sequence
  intronic recognition element for splicing modifier (REMS)
  misc_feature (1)..(1): n is a, c, g, or u
ncgagurugc

SEQ ID NO: 325 - RNA, 10 nt, Artificial Sequence
  intronic recognition element for splicing modifier (REMS)
acgagurugc

SEQ ID NO: 326 - RNA, 10 nt, Artificial Sequence
  intronic recognition element for splicing modifier (REMS)
ccgagurugc

SEQ ID NO: 327 - RNA, 10 nt, Artificial Sequence
  intronic recognition element for splicing modifier (REMS)
gcgagurugc

SEQ ID NO: 328 - RNA, 10 nt, Artificial Sequence
  intronic recognition element for splicing modifier (REMS)
ucgagurugc

SEQ ID NO: 329 - RNA, 10 nt, Artificial Sequence
  intronic recognition element for splicing modifier (REMS)
  misc_feature (2)..(2): n is a, c, g, or u
gngagurugc

SEQ ID NO: 330 - RNA, 10 nt, Artificial Sequence
  intronic recognition element for splicing modifier (REMS)
  misc_feature (1)..(1): n is a, c, g, or u
nggagurugc

SEQ ID NO: 331 - RNA, 10 nt, Artificial Sequence
  intronic recognition element for splicing modifier (REMS)
aggagurugc

SEQ ID NO: 332 - RNA, 10 nt, Artificial Sequence
  intronic recognition element for splicing modifier (REMS)
cggagurugc

SEQ ID NO: 333 - RNA, 10 nt, Artificial Sequence
  intronic recognition element for splicing modifier (REMS)
gggagurugc

SEQ ID NO: 334 - RNA, 10 nt, Artificial Sequence
  intronic recognition element for splicing modifier (REMS)
uggagurugc

SEQ ID NO: 335 - RNA, 10 nt, Artificial Sequence
  intronic recognition element for splicing modifier (REMS)
  misc_feature (2)..(2): n is a, c, g, or u
ungagurugc

SEQ ID NO: 336 - RNA, 10 nt, Artificial Sequence
  intronic recognition element for splicing modifier (REMS)
  misc_feature (1)..(1): n is a, c, g, or u
nugagurugc

SEQ ID NO: 337 - RNA, 10 nt, Artificial Sequence
  intronic recognition element for splicing modifier (REMS)
augagurugc

SEQ ID NO: 338 - RNA, 10 nt, Artificial Sequence
  intronic recognition element for splicing modifier (REMS)
cugagurugc

SEQ ID NO: 339 - RNA, 10 nt, Artificial Sequence
  intronic recognition element for splicing modifier (REMS)
gugagurugc

SEQ ID NO: 340 - RNA, 10 nt, Artificial Sequence
  intronic recognition element for splicing modifier (REMS)
uugagurugc

SEQ ID NO: 341 - RNA, 10 nt, Artificial Sequence
  intronic recognition element for splicing modifier (REMS)
  misc_feature (2)..(2): n is a, c, g, or u
angaguragg

SEQ ID NO: 342 - RNA, 10 nt, Artificial Sequence
  intronic recognition element for splicing modifier (REMS)
  misc_feature (1)..(1): n is a, c, g, or u
nagaguragg

SEQ ID NO: 343 - RNA, 10 nt, Artificial Sequence
  intronic recognition element for splicing modifier (REMS)
aagaguragg

SEQ ID NO: 344 - RNA, 10 nt, Artificial Sequence
  intronic recognition element for splicing modifier (REMS)
cagaguragg

SEQ ID NO: 345 - RNA, 10 nt, Artificial Sequence
  intronic recognition element for splicing modifier (REMS)
gagaguragg

SEQ ID NO: 346 - RNA, 10 nt, Artificial Sequence
  intronic recognition element for splicing modifier (REMS)
uagaguragg

SEQ ID NO: 347 - RNA, 10 nt, Artificial Sequence
  intronic recognition element for splicing modifier (REMS)
  misc_feature (2)..(2): n is a, c, g, or u
cngaguragg

SEQ ID NO: 348 - RNA, 10 nt, Artificial Sequence
  intronic recognition element for splicing modifier (REMS)
  misc_feature (1)..(1): n is a, c, g, or u
ncgaguragg

SEQ ID NO: 349 - RNA, 10 nt, Artificial Sequence
  intronic recognition element for splicing modifier (REMS)
acgaguragg

SEQ ID NO: 350 - RNA, 10 nt, Artificial Sequence
  intronic recognition element for splicing modifier (REMS)
ccgaguragg

SEQ ID NO: 351 - RNA, 10 nt, Artificial Sequence
  intronic recognition element for splicing modifier (REMS)
gcgaguragg

SEQ ID NO: 352 - RNA, 10 nt, Artificial Sequence
  intronic recognition element for splicing modifier (REMS)
ucgaguragg

SEQ ID NO: 353 - RNA, 10 nt, Artificial Sequence
  intronic recognition element for splicing modifier (REMS)
  misc_feature (2)..(2): n is a, c, g, or u
gngaguragg

SEQ ID NO: 354 - RNA, 10 nt, Artificial Sequence
  intronic recognition element for splicing modifier (REMS)
  misc_feature (1)..(1): n is a, c, g, or u
nggaguragg

SEQ ID NO: 355 - RNA, 10 nt, Artificial Sequence
  intronic recognition element for splicing modifier (REMS)
aggaguragg

SEQ ID NO: 356 - RNA, 10 nt, Artificial Sequence
  intronic recognition element for splicing modifier (REMS)
cggaguragg

SEQ ID NO: 357 - RNA, 10 nt, Artificial Sequence
  intronic recognition element for splicing modifier (REMS)
gggaguragg

SEQ ID NO: 358 - RNA, 10 nt, Artificial Sequence
  intronic recognition element for splicing modifier (REMS)
uggaguragg

SEQ ID NO: 359 - RNA, 10 nt, Artificial Sequence
  intronic recognition element for splicing modifier (REMS)
  misc_feature (2)..(2): n is a, c, g, or u
ungaguragg

SEQ ID NO: 360 - RNA, 10 nt, Artificial Sequence
  intronic recognition element for splicing modifier (REMS)
  misc_feature (1)..(1): n is a, c, g, or u
nugaguragg

SEQ ID NO: 361 - RNA, 10 nt, Artificial Sequence
  intronic recognition element for splicing modifier (REMS)
augaguragg

SEQ ID NO: 362 - RNA, 10 nt, Artificial Sequence
  intronic recognition element for splicing modifier (REMS)
cugaguragg

SEQ ID NO: 363 - RNA, 10 nt, Artificial Sequence
  intronic recognition element for splicing modifier (REMS)
gugaguragg

SEQ ID NO: 364 - RNA, 10 nt, Artificial Sequence
  intronic recognition element for splicing modifier (REMS)
uugaguragg

SEQ ID NO: 365 - RNA, 10 nt, Artificial Sequence
  intronic recognition element for splicing modifier (REMS)
  misc_feature (2)..(2): n is a, c, g, or u
angagurcgg

SEQ ID NO: 366 - RNA, 10 nt, Artificial Sequence
  intronic recognition element for splicing modifier (REMS)
  misc_feature (1)..(1): n is a, c, g, or u
nagagurcgg

SEQ ID NO: 367 - RNA, 10 nt, Artificial Sequence
  intronic recognition element for splicing modifier (REMS)
aagagurcgg

SEQ ID NO: 368 - RNA, 10 nt, Artificial Sequence
  intronic recognition element for splicing modifier (REMS)
cagagurcgg

SEQ ID NO: 369 - RNA, 10 nt, Artificial Sequence
  intronic recognition element for splicing modifier (REMS)
gagagurcgg

SEQ ID NO: 370 - RNA, 10 nt, Artificial Sequence
  intronic recognition element for splicing modifier (REMS)
uagagurcgg

SEQ ID NO: 371 - RNA, 10 nt, Artificial Sequence
  intronic recognition element for splicing modifier (REMS)
  misc_feature (2)..(2): n is a, c, g, or u
cngagurcgg

SEQ ID NO: 372 - RNA, 10 nt, Artificial Sequence
  intronic recognition element for splicing modifier (REMS)
  misc_feature (1)..(1): n is a, c, g, or u
ncgagurcgg

SEQ ID NO: 373 - RNA, 10 nt, Artificial Sequence
  intronic recognition element for splicing modifier (REMS)
acgagurcgg

SEQ ID NO: 374 - RNA, 10 nt, Artificial Sequence
  intronic recognition element for splicing modifier (REMS)
ccgagurcgg

SEQ ID NO: 375 - RNA, 10 nt, Artificial Sequence
  intronic recognition element for splicing modifier (REMS)
gcgagurcgg

SEQ ID NO: 376 - RNA, 10 nt, Artificial Sequence
  intronic recognition element for splicing modifier (REMS)
ucgagurcgg

SEQ ID NO: 377 - RNA, 10 nt, Artificial Sequence
  intronic recognition element for splicing modifier (REMS)
  misc_feature (2)..(2): n is a, c, g, or u
gngagurcgg

SEQ ID NO: 378 - RNA, 10 nt, Artificial Sequence
  intronic recognition element for splicing modifier (REMS)
  misc_feature (1)..(1): n is a, c, g, or u
nggagurcgg

SEQ ID NO: 379 - RNA, 10 nt, Artificial Sequence
  intronic recognition element for splicing modifier (REMS)
aggagurcgg

SEQ ID NO: 380 - RNA, 10 nt, Artificial Sequence
  intronic recognition element for splicing modifier (REMS)
cggagurcgg

SEQ ID NO: 381 - RNA, 10 nt, Artificial Sequence
  intronic recognition element for splicing modifier (REMS)
gggagurcgg

SEQ ID NO: 382 - RNA, 10 nt, Artificial Sequence
  intronic recognition element for splicing modifier (REMS)
uggagurcgg

SEQ ID NO: 383 - RNA, 10 nt, Artificial Sequence
  intronic recognition element for splicing modifier (REMS)
  misc_feature (2)..(2): n is a, c, g, or u
ungagurcgg

SEQ ID NO: 384 - RNA, 10 nt, Artificial Sequence
  intronic recognition element for splicing modifier (REMS)
  misc_feature (1)..(1): n is a, c, g, or u
nugagurcgg

SEQ ID NO: 385 - RNA, 10 nt, Artificial Sequence
  intronic recognition element for splicing modifier (REMS)
augagurcgg

SEQ ID NO: 386 - RNA, 10 nt, Artificial Sequence
  intronic recognition element for splicing modifier (REMS)
cugagurcgg

SEQ ID NO: 387 - RNA, 10 nt, Artificial Sequence
  intronic recognition element for splicing modifier (REMS)
gugagurcgg

SEQ ID NO: 388 - RNA, 10 nt, Artificial Sequence
  intronic recognition element for splicing modifier (REMS)
uugagurcgg

SEQ ID NO: 389 - RNA, 10 nt, Artificial Sequence
  intronic recognition element for splicing modifier (REMS)
  misc_feature (2)..(2): n is a, c, g, or u
angagurggg

SEQ ID NO: 390 - RNA, 10 nt, Artificial Sequence
  intronic recognition element for splicing modifier (REMS)
  misc_feature (1)..(1): n is a, c, g, or u
nagagurggg

SEQ ID NO: 391 - RNA, 10 nt, Artificial Sequence
  intronic recognition element for splicing modifier (REMS)
aagagurggg

SEQ ID NO: 392 - RNA, 10 nt, Artificial Sequence
  intronic recognition element for splicing modifier (REMS)
cagagurggg

SEQ ID NO: 393 - RNA, 10 nt, Artificial Sequence
  intronic recognition element for splicing modifier (REMS)
gagagurggg

SEQ ID NO: 394 - RNA, 10 nt, Artificial Sequence
  intronic recognition element for splicing modifier (REMS)
uagagurggg

SEQ ID NO: 395 - RNA, 10 nt, Artificial Sequence
  intronic recognition element for splicing modifier (REMS)
  misc_feature (2)..(2): n is a, c, g, or u
cngagurggg

SEQ ID NO: 396 - RNA, 10 nt, Artificial Sequence
  intronic recognition element for splicing modifier (REMS)
  misc_feature (1)..(1): n is a, c, g, or u
ncgagurggg

SEQ ID NO: 397 - RNA, 10 nt, Artificial Sequence
  intronic recognition element for splicing modifier (REMS)
acgagurggg

SEQ ID NO: 398 - RNA, 10 nt, Artificial Sequence
  intronic recognition element for splicing modifier (REMS)
ccgagurggg

SEQ ID NO: 399 - RNA, 10 nt, Artificial Sequence
  intronic recognition element for splicing modifier (REMS)
gcgagurggg

SEQ ID NO: 400 - RNA, 10 nt, Artificial Sequence
  intronic recognition element for splicing modifier (REMS)
ucgagurggg

SEQ ID NO: 401 - RNA, 10 nt, Artificial Sequence
  intronic recognition element for splicing modifier (REMS)
  misc_feature (2)..(2): n is a, c, g, or u
gngagurggg

SEQ ID NO: 402 - RNA, 10 nt, Artificial Sequence
  intronic recognition element for splicing modifier (REMS)
  misc_feature (1)..(1): n is a, c, g, or u
nggagurggg

SEQ ID NO: 403 - RNA, 10 nt, Artificial Sequence
  intronic recognition element for splicing modifier (REMS)
aggagurggg

SEQ ID NO: 404 - RNA, 10 nt, Artificial Sequence
  intronic recognition element for splicing modifier (REMS)
cggagurggg

SEQ ID NO: 405 - RNA, 10 nt, Artificial Sequence
  intronic recognition element for splicing modifier (REMS)
gggagurggg

SEQ ID NO: 406 - RNA, 10 nt, Artificial Sequence
  intronic recognition element for splicing modifier (REMS)
uggagurggg

SEQ ID NO: 407 - RNA, 10 nt, Artificial Sequence
  intronic recognition element for splicing modifier (REMS)
  misc_feature (2)..(2): n is a, c, g, or u
ungagurggg

SEQ ID NO: 408 - RNA, 10 nt, Artificial Sequence
  intronic recognition element for splicing modifier (REMS)
  misc_feature (1)..(1): n is a, c, g, or u
nugagurggg

SEQ ID NO: 409 - RNA, 10 nt, Artificial Sequence
  intronic recognition element for splicing modifier (REMS)
augagurggg

SEQ ID NO: 410 - RNA, 10 nt, Artificial Sequence
  intronic recognition element for splicing modifier (REMS)
cugagurggg

SEQ ID NO: 411 - RNA, 10 nt, Artificial Sequence
  intronic recognition element for splicing modifier (REMS)
gugagurggg

SEQ ID NO: 412 - RNA, 10 nt, Artificial Sequence
  intronic recognition element for splicing modifier (REMS)
uugagurggg

SEQ ID NO: 413 - RNA, 10 nt, Artificial Sequence
  intronic recognition element for splicing modifier (REMS)
  misc_feature (2)..(2): n is a, c, g, or u
angagurugg

SEQ ID NO: 414 - RNA, 10 nt, Artificial Sequence
  intronic recognition element for splicing modifier (REMS)
  misc_feature (1)..(1): n is a, c, g, or u
nagagurugg

SEQ ID NO: 415 - RNA, 10 nt, Artificial Sequence
  intronic recognition element for splicing modifier (REMS)
aagagurugg

SEQ ID NO: 416 - RNA, 10 nt, Artificial Sequence
  intronic recognition element for splicing modifier (REMS)
cagagurugg

SEQ ID NO: 417 - RNA, 10 nt, Artificial Sequence
  intronic recognition element for splicing modifier (REMS)
gagagurugg

SEQ ID NO: 418 - RNA, 10 nt, Artificial Sequence
  intronic recognition element for splicing modifier (REMS)
uagagurugg

SEQ ID NO: 419 - RNA, 10 nt, Artificial Sequence
  intronic recognition element for splicing modifier (REMS)
  misc_feature (2)..(2): n is a, c, g, or u
cngagurugg

SEQ ID NO: 420 - RNA, 10 nt, Artificial Sequence
  intronic recognition element for splicing modifier (REMS)
  misc_feature (1)..(1): n is a, c, g, or u
ncgagurugg

SEQ ID NO: 421 - RNA, 10 nt, Artificial Sequence
  intronic recognition element for splicing modifier (REMS)
acgagurugg

SEQ ID NO: 422 - RNA, 10 nt, Artificial Sequence
  intronic recognition element for splicing modifier (REMS)
ccgagurugg

SEQ ID NO: 423 - RNA, 10 nt, Artificial Sequence
  intronic recognition element for splicing modifier (REMS)
gcgagurugg

SEQ ID NO: 424 - RNA, 10 nt, Artificial Sequence
  intronic recognition element for splicing modifier (REMS)
ucgagurugg

SEQ ID NO: 425 - RNA, 10 nt, Artificial Sequence
  intronic recognition element for splicing modifier (REMS)
  misc_feature (2)..(2): n is a, c, g, or u
gngagurugg

SEQ ID NO: 426 - RNA, 10 nt, Artificial Sequence
  intronic recognition element for splicing modifier (REMS)
  misc_feature (1)..(1): n is a, c, g, or u
nggagurugg

SEQ ID NO: 427 - RNA, 10 nt, Artificial Sequence
  intronic recognition element for splicing modifier (REMS)
aggagurugg

SEQ ID NO: 428 - RNA, 10 nt, Artificial Sequence
  intronic recognition element for splicing modifier (REMS)
cggagurugg

SEQ ID NO: 429 - RNA, 10 nt, Artificial Sequence
  intronic recognition element for splicing modifier (REMS)
gggagurugg

SEQ ID NO: 430 - RNA, 10 nt, Artificial Sequence
  intronic recognition element for splicing modifier (REMS)
uggagurugg

SEQ ID NO: 431 - RNA, 10 nt, Artificial Sequence
  intronic recognition element for splicing modifier (REMS)
  misc_feature (2)..(2): n is a, c, g, or u
ungagurugg

SEQ ID NO: 432 - RNA, 10 nt, Artificial Sequence
  intronic recognition element for splicing modifier (REMS)
  misc_feature (1)..(1): n is a, c, g, or u
nugagurugg

SEQ ID NO: 433 - RNA, 10 nt, Artificial Sequence
  intronic recognition element for splicing modifier (REMS)
augagurugg

SEQ ID NO: 434 - RNA, 10 nt, Artificial Sequence
  intronic recognition element for splicing modifier (REMS)
cugagurugg

SEQ ID NO: 435 - RNA, 10 nt, Artificial Sequence
  intronic recognition element for splicing modifier (REMS)
gugagurugg

SEQ ID NO: 436 - RNA, 10 nt, Artificial Sequence
  intronic recognition element for splicing modifier (REMS)
uugagurugg

SEQ ID NO: 437 - RNA, 10 nt, Artificial Sequence
  intronic recognition element for splicing modifier (REMS)
  misc_feature (2)..(2): n is a, c, g, or u
angaguragu

SEQ ID NO: 438 - RNA, 10 nt, Artificial Sequence
  intronic recognition element for splicing modifier (REMS)
  misc_feature (1)..(1): n is a, c, g, or u
nagaguragu

SEQ ID NO: 439 - RNA, 10 nt, Artificial Sequence
  intronic recognition element for splicing modifier (REMS)
aagaguragu

SEQ ID NO: 440 - RNA, 10 nt, Artificial Sequence
  intronic recognition element for splicing modifier (REMS)
cagaguragu

SEQ ID NO: 441 - RNA, 10 nt, Artificial Sequence
  intronic recognition element for splicing modifier (REMS)
gagaguragu

SEQ ID NO: 442 - RNA, 10 nt, Artificial Sequence
  intronic recognition element for splicing modifier (REMS)
uagaguragu

SEQ ID NO: 443 - RNA, 10 nt, Artificial Sequence
  intronic recognition element for splicing modifier (REMS)
  misc_feature (2)..(2): n is a, c, g, or u
cngaguragu

SEQ ID NO: 444 - RNA, 10 nt, Artificial Sequence
  intronic recognition element for splicing modifier (REMS)
  misc_feature (1)..(1): n is a, c, g, or u
ncgaguragu

SEQ ID NO: 445 - RNA, 10 nt, Artificial Sequence
  intronic recognition element for splicing modifier (REMS)
acgaguragu

SEQ ID NO: 446 - RNA, 10 nt, Artificial Sequence
  intronic recognition element for splicing modifier (REMS)
ccgaguragu

SEQ ID NO: 447 - RNA, 10 nt, Artificial Sequence
  intronic recognition element for splicing modifier (REMS)
gcgaguragu

SEQ ID NO: 448 - RNA, 10 nt, Artificial Sequence
  intronic recognition element for splicing modifier (REMS)
ucgaguragu

SEQ ID NO: 449 - RNA, 10 nt, Artificial Sequence
  intronic recognition element for splicing modifier (REMS)
  misc_feature (2)..(2): n is a, c, g, or u
gngaguragu

SEQ ID NO: 450 - RNA, 10 nt, Artificial Sequence
  intronic recognition element for splicing modifier (REMS)
  misc_feature (1)..(1): n is a, c, g, or u
nggaguragu

SEQ ID NO: 451 - RNA, 10 nt, Artificial Sequence
  intronic recognition element for splicing modifier (REMS)
aggaguragu

SEQ ID NO: 452 - RNA, 10 nt, Artificial Sequence
  intronic recognition element for splicing modifier (REMS)
cggaguragu

SEQ ID NO: 453 - RNA, 10 nt, Artificial Sequence
  intronic recognition element for splicing modifier (REMS)
gggaguragu

SEQ ID NO: 454 - RNA, 10 nt, Artificial Sequence
  intronic recognition element for splicing modifier (REMS)
uggaguragu

SEQ ID NO: 455 - RNA, 10 nt, Artificial Sequence
  intronic recognition element for splicing modifier (REMS)
  misc_feature (2)..(2): n is a, c, g, or u
ungaguragu

SEQ ID NO: 456 - RNA, 10 nt, Artificial Sequence
  intronic recognition element for splicing modifier (REMS)
  misc_feature (1)..(1): n is a, c, g, or u
nugaguragu

SEQ ID NO: 457 - RNA, 10 nt, Artificial Sequence
  intronic recognition element for splicing modifier (REMS)
augaguragu

SEQ ID NO: 458 - RNA, 10 nt, Artificial Sequence
  intronic recognition element for splicing modifier (REMS)
cugaguragu

SEQ ID NO: 459 - RNA, 10 nt, Artificial Sequence
  intronic recognition element for splicing modifier (REMS)
gugaguragu

SEQ ID NO: 460 - RNA, 10 nt, Artificial Sequence
  intronic recognition element for splicing modifier (REMS)
uugaguragu

SEQ ID NO: 461 - RNA, 10 nt, Artificial Sequence
  intronic recognition element for splicing modifier (REMS)
  misc_feature (2)..(2): n is a, c, g, or u
angagurcgu

SEQ ID NO: 462 - RNA, 10 nt, Artificial Sequence
  intronic recognition element for splicing modifier (REMS)
  misc_feature (1)..(1): n is a, c, g, or u
nagagurcgu

SEQ ID NO: 463 - RNA, 10 nt, Artificial Sequence
  intronic recognition element for splicing modifier (REMS)
aagagurcgu

SEQ ID NO: 464 - RNA, 10 nt, Artificial Sequence
  intronic recognition element for splicing modifier (REMS)
cagagurcgu

SEQ ID NO: 465 - RNA, 10 nt, Artificial Sequence
  intronic recognition element for splicing modifier (REMS)
gagagurcgu

SEQ ID NO: 466 - RNA, 10 nt, Artificial Sequence
  intronic recognition element for splicing modifier (REMS)
uagagurcgu

SEQ ID NO: 467 - RNA, 10 nt, Artificial Sequence
  intronic recognition element for splicing modifier (REMS)
  misc_feature (2)..(2): n is a, c, g, or u
cngagurcgu

SEQ ID NO: 468 - RNA, 10 nt, Artificial Sequence
  intronic recognition element for splicing modifier (REMS)
  misc_feature (1)..(1): n is a, c, g, or u
ncgagurcgu

SEQ ID NO: 469 - RNA, 10 nt, Artificial Sequence
  intronic recognition element for splicing modifier (REMS)
acgagurcgu

SEQ ID NO: 470 - RNA, 10 nt, Artificial Sequence
  intronic recognition element for splicing modifier (REMS)
ccgagurcgu

SEQ ID NO: 471 - RNA, 10 nt, Artificial Sequence
  intronic recognition element for splicing modifier (REMS)
gcgagurcgu

SEQ ID NO: 472 - RNA, 10 nt, Artificial Sequence
  intronic recognition element for splicing modifier (REMS)
ucgagurcgu

SEQ ID NO: 473 - RNA, 10 nt, Artificial Sequence
  intronic recognition element for splicing modifier (REMS)
  misc_feature (2)..(2): n is a, c, g, or u
gngagurcgu

SEQ ID NO: 474 - RNA, 10 nt, Artificial Sequence
  intronic recognition element for splicing modifier (REMS)
  misc_feature (1)..(1): n is a, c, g, or u
nggagurcgu

SEQ ID NO: 475 - RNA, 10 nt, Artificial Sequence
  intronic recognition element for splicing modifier (REMS)
aggagurcgu

SEQ ID NO: 476 - RNA, 10 nt, Artificial Sequence
  intronic recognition element for splicing modifier (REMS)
cggagurcgu

SEQ ID NO: 477 - RNA, 10 nt, Artificial Sequence
  intronic recognition element for splicing modifier (REMS)
gggagurcgu

SEQ ID NO: 478 - RNA, 10 nt, Artificial Sequence
  intronic recognition element for splicing modifier (REMS)
uggagurcgu

SEQ ID NO: 479 - RNA, 10 nt, Artificial Sequence
  intronic recognition element for splicing modifier (REMS)
  misc_feature (2)..(2): n is a, c, g, or u
ungagurcgu

SEQ ID NO: 480 - RNA, 10 nt, Artificial Sequence
  intronic recognition element for splicing modifier (REMS)
  misc_feature (1)..(1): n is a, c, g, or u
nugagurcgu

SEQ ID NO: 481 - RNA, 10 nt, Artificial Sequence
  intronic recognition element for splicing modifier (REMS)
augagurcgu

SEQ ID NO: 482 - RNA, 10 nt, Artificial Sequence
  intronic recognition element for splicing modifier (REMS)
cugagurcgu

SEQ ID NO: 483 - RNA, 10 nt, Artificial Sequence
  intronic recognition element for splicing modifier (REMS)
gugagurcgu

SEQ ID NO: 484 - RNA, 10 nt, Artificial Sequence
  intronic recognition element for splicing modifier (REMS)
uugagurcgu

SEQ ID NO: 485 - RNA, 10 nt, Artificial Sequence
  intronic recognition element for splicing modifier (REMS)
  misc_feature (2)..(2): n is a, c, g, or u
angagurggu

SEQ ID NO: 486 - RNA, 10 nt, Artificial Sequence
  intronic recognition element for splicing modifier (REMS)
  misc_feature (1)..(1): n is a, c, g, or u
nagagurggu

SEQ ID NO: 487 - RNA, 10 nt, Artificial Sequence
  intronic recognition element for splicing modifier (REMS)
aagagurggu

SEQ ID NO: 488 - RNA, 10 nt, Artificial Sequence
  intronic recognition element for splicing modifier (REMS)
cagagurggu

SEQ ID NO: 489 - RNA, 10 nt, Artificial Sequence
  intronic recognition element for splicing modifier (REMS)
gagagurggu

SEQ ID NO: 490 - RNA, 10 nt, Artificial Sequence
  intronic recognition element for splicing modifier (REMS)
uagagurggu

SEQ ID NO: 491 - RNA, 10 nt, Artificial Sequence
  intronic recognition element for splicing modifier (REMS)
  misc_feature (2)..(2): n is a, c, g, or u
cngagurggu

SEQ ID NO: 492 - RNA, 10 nt, Artificial Sequence
  intronic recognition element for splicing modifier (REMS)
  misc_feature (1)..(1): n is a, c, g, or u
ncgagurggu

SEQ ID NO: 493 - RNA, 10 nt, Artificial Sequence
  intronic recognition element for splicing modifier (REMS)
acgagurggu

SEQ ID NO: 494 - RNA, 10 nt, Artificial Sequence
  intronic recognition element for splicing modifier (REMS)
ccgagurggu

SEQ ID NO: 495 - RNA, 10 nt, Artificial Sequence
  intronic recognition element for splicing modifier (REMS)
gcgagurggu

SEQ ID NO: 496 - RNA, 10 nt, Artificial Sequence
  intronic recognition element for splicing modifier (REMS)
ucgagurggu

SEQ ID NO: 497 - RNA, 10 nt, Artificial Sequence
  intronic recognition element for splicing modifier (REMS)
  misc_feature (2)..(2): n is a, c, g, or u
gngagurggu

SEQ ID NO: 498 - RNA, 10 nt, Artificial Sequence
  intronic recognition element for splicing modifier (REMS)
  misc_feature (1)..(1): n is a, c, g, or u
nggagurggu

SEQ ID NO: 499 - RNA, 10 nt, Artificial Sequence
  intronic recognition element for splicing modifier (REMS)
aggagurggu

SEQ ID NO: 500 - RNA, 10 nt, Artificial Sequence
  intronic recognition element for splicing modifier (REMS)
cggagurggu

SEQ ID NO: 501 - RNA, 10 nt, Artificial Sequence
  intronic recognition element for splicing modifier (REMS)
gggagurggu

SEQ ID NO: 502 - RNA, 10 nt, Artificial Sequence
  intronic recognition element for splicing modifier (REMS)
uggagurggu

SEQ ID NO: 503 - RNA, 10 nt, Artificial Sequence
  intronic recognition element for splicing modifier (REMS)
  misc_feature (2)..(2): n is a, c, g, or u
ungagurggu

SEQ ID NO: 504 - RNA, 10 nt, Artificial Sequence
  intronic recognition element for splicing modifier (REMS)
  misc_feature (1)..(1): n is a, c, g, or u
nugagurggu

SEQ ID NO: 505 - RNA, 10 nt, Artificial Sequence
  intronic recognition element for splicing modifier (REMS)
augagurggu

SEQ ID NO: 506 - RNA, 10 nt, Artificial Sequence
  intronic recognition element for splicing modifier (REMS)
cugagurggu

SEQ ID NO: 507 - RNA, 10 nt, Artificial Sequence
  intronic recognition element for splicing modifier (REMS)
gugagurggu

SEQ ID NO: 508 - RNA, 10 nt, Artificial Sequence
  intronic recognition element for splicing modifier (REMS)
uugagurggu

SEQ ID NO: 509 - RNA, 10 nt, Artificial Sequence
  intronic recognition element for splicing modifier (REMS)
  misc_feature (2)..(2): n is a, c, g, or u
angagurugu

SEQ ID NO: 510 - RNA, 10 nt, Artificial Sequence
  intronic recognition element for splicing modifier (REMS)
  misc_feature (1)..(1): n is a, c, g, or u
nagagurugu

SEQ ID NO: 511 - RNA, 10 nt, Artificial Sequence
  intronic recognition element for splicing modifier (REMS)
aagagurugu

SEQ ID NO: 512 - RNA, 10 nt, Artificial Sequence
  intronic recognition element for splicing modifier (REMS)
cagagurugu

SEQ ID NO: 513 - RNA, 10 nt, Artificial Sequence
  intronic recognition element for splicing modifier (REMS)
gagagurugu

SEQ ID NO: 514 - RNA, 10 nt, Artificial Sequence
  intronic recognition element for splicing modifier (REMS)
uagagurugu

SEQ ID NO: 515 - RNA, 10 nt, Artificial Sequence
  intronic recognition element for splicing modifier (REMS)
  misc_feature (2)..(2): n is a, c, g, or u
cngagurugu

SEQ ID NO: 516 - RNA, 10 nt, Artificial Sequence
  intronic recognition element for splicing modifier (REMS)
  misc_feature (1)..(1): n is a, c, g, or u
ncgagurugu

SEQ ID NO: 517 - RNA, 10 nt, Artificial Sequence
  intronic recognition element for splicing modifier (REMS)
acgagurugu

SEQ ID NO: 518 - RNA, 10 nt, Artificial Sequence
  intronic recognition element for splicing modifier (REMS)
ccgagurugu

SEQ ID NO: 519 - RNA, 10 nt, Artificial Sequence
  intronic recognition element for splicing modifier (REMS)
gcgagurugu

SEQ ID NO: 520 - RNA, 10 nt, Artificial Sequence
  intronic recognition element for splicing modifier (REMS)
ucgagurugu

SEQ ID NO: 521 - RNA, 10 nt, Artificial Sequence
  intronic recognition element for splicing modifier (REMS)
  misc_feature (2)..(2): n is a, c, g, or u
gngagurugu

SEQ ID NO: 522 - RNA, 10 nt, Artificial Sequence
  intronic recognition element for splicing modifier (REMS)
  misc_feature (1)..(1): n is a, c, g, or u
nggagurugu

SEQ ID NO: 523 - RNA, 10 nt, Artificial Sequence
  intronic recognition element for splicing modifier (REMS)
aggagurugu

SEQ ID NO: 524 - RNA, 10 nt, Artificial Sequence
  intronic recognition element for splicing modifier (REMS)
cggagurugu

SEQ ID NO: 525 - RNA, 10 nt, Artificial Sequence
  intronic recognition element for splicing modifier (REMS)
gggagurugu

SEQ ID NO: 526 - RNA, 10 nt, Artificial Sequence
  intronic recognition element for splicing modifier (REMS)
uggagurugu

SEQ ID NO: 527 - RNA, 10 nt, Artificial Sequence
  intronic recognition element for splicing modifier (REMS)
  misc_feature (2)..(2): n is a, c, g, or u
ungagurugu

SEQ ID NO: 528 - RNA, 10 nt, Artificial Sequence
  intronic recognition element for splicing modifier (REMS)
  misc_feature (1)..(1): n is a, c, g, or u
nugagurugu

SEQ ID NO: 529 - RNA, 10 nt, Artificial Sequence
  intronic recognition element for splicing modifier (REMS)
augagurugu

SEQ ID NO: 530 - RNA, 10 nt, Artificial Sequence
  intronic recognition element for splicing modifier (REMS)
cugagurugu

SEQ ID NO: 531 - RNA, 10 nt, Artificial Sequence
  intronic recognition element for splicing modifier (REMS)
gugagurugu

SEQ ID NO: 532 - RNA, 10 nt, Artificial Sequence
  intronic recognition element for splicing modifier (REMS)
uugagurugu

SEQ ID NO: 533 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angagurnga

SEQ ID NO: 534 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagagurnga

SEQ ID NO: 535 - RNA, 10 nt, Artificial Sequence
  intronic recognition element for splicing modifier (REMS)
  misc_feature (8)..(8): n is a, c, g, or u
aagagurnga

SEQ ID NO: 536 - RNA, 10 nt, Artificial Sequence
  intronic recognition element for splicing modifier (REMS)
  misc_feature (8)..(8): n is a, c, g, or u
cagagurnga

SEQ ID NO: 537 - RNA, 10 nt, Artificial Sequence
  intronic recognition element for splicing modifier (REMS)
  misc_feature (8)..(8): n is a, c, g, or u
gagagurnga

SEQ ID NO: 538 - RNA, 10 nt, Artificial Sequence
  intronic recognition element for splicing modifier (REMS)
  misc_feature (8)..(8): n is a, c, g, or u
uagagurnga

SEQ ID NO: 539 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngagurnga

SEQ ID NO: 540 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgagurnga

SEQ ID NO: 541 - RNA, 10 nt, Artificial Sequence
  intronic recognition element for splicing modifier (REMS)
  misc_feature (8)..(8): n is a, c, g, or u
acgagurnga

SEQ ID NO: 542 - RNA, 10 nt, Artificial Sequence
  intronic recognition element for splicing modifier (REMS)
  misc_feature (8)..(8): n is a, c, g, or u
ccgagurnga

SEQ ID NO: 543 - RNA, 10 nt, Artificial Sequence
  intronic recognition element for splicing modifier (REMS)
  misc_feature (8)..(8): n is a, c, g, or u
gcgagurnga

SEQ ID NO: 544 - RNA, 10 nt, Artificial Sequence
  intronic recognition element for splicing modifier (REMS)
  misc_feature (8)..(8): n is a, c, g, or u
ucgagurnga

SEQ ID NO: 545 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngagurnga

SEQ ID NO: 546 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggagurnga

SEQ ID NO: 547 - RNA, 10 nt, Artificial Sequence
  intronic recognition element for splicing modifier (REMS)
  misc_feature (8)..(8): n is a, c, g, or u
aggagurnga

SEQ ID NO: 548 - RNA, 10 nt, Artificial Sequence
  intronic recognition element for splicing modifier (REMS)
  misc_feature (8)..(8): n is a, c, g, or u
cggagurnga

SEQ ID NO: 549 - RNA, 10 nt, Artificial Sequence
  intronic recognition element for splicing modifier (REMS)
  misc_feature (8)..(8): n is a, c, g, or u
gggagurnga

SEQ ID NO: 550 - RNA, 10 nt, Artificial Sequence
  intronic recognition element for splicing modifier (REMS)
  misc_feature (8)..(8): n is a, c, g, or u
uggagurnga

SEQ ID NO: 551 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungagurnga

SEQ ID NO: 552 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugagurnga

SEQ ID NO: 553 - RNA, 10 nt, Artificial Sequence
  intronic recognition element for splicing modifier (REMS)
  misc_feature (8)..(8): n is a, c, g, or u
augagurnga

SEQ ID NO: 554 - RNA, 10 nt, Artificial Sequence
  intronic recognition element for splicing modifier (REMS)
  misc_feature (8)..(8): n is a, c, g, or u
cugagurnga

SEQ ID NO: 555 - RNA, 10 nt, Artificial Sequence
  intronic recognition element for splicing modifier (REMS)
  misc_feature (8)..(8): n is a, c, g, or u
gugagurnga

SEQ ID NO: 556 - RNA, 10 nt, Artificial Sequence
  intronic recognition element for splicing modifier (REMS)
  misc_feature (8)..(8): n is a, c, g, or u
uugagurnga

SEQ ID NO: 557 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angagurngc

SEQ ID NO: 558 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagagurngc

SEQ ID NO: 559 - RNA, 10 nt, Artificial Sequence
  intronic recognition element for splicing modifier (REMS)
  misc_feature (8)..(8): n is a, c, g, or u
aagagurngc

SEQ ID NO: 560 - RNA, 10 nt, Artificial Sequence
  intronic recognition element for splicing modifier (REMS)
  misc_feature (8)..(8): n is a, c, g, or u
cagagurngc

SEQ ID NO: 561 - RNA, 10 nt, Artificial Sequence
  intronic recognition element for splicing modifier (REMS)
  misc_feature (8)..(8): n is a, c, g, or u
gagagurngc

SEQ ID NO: 562 - RNA, 10 nt, Artificial Sequence
  intronic recognition element for splicing modifier (REMS)
  misc_feature (8)..(8): n is a, c, g, or u
uagagurngc

SEQ ID NO: 563 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngagurngc

SEQ ID NO: 564 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgagurngc

SEQ ID NO: 565 - RNA, 10 nt, Artificial Sequence
  intronic recognition element for splicing modifier (REMS)
  misc_feature (8)..(8): n is a, c, g, or u
acgagurngc

SEQ ID NO: 566 - RNA, 10 nt, Artificial Sequence
  intronic recognition element for splicing modifier (REMS)
  misc_feature (8)..(8): n is a, c, g, or u
ccgagurngc

SEQ ID NO: 567 - RNA, 10 nt, Artificial Sequence
  intronic recognition element for splicing modifier (REMS)
  misc_feature (8)..(8): n is a, c, g, or u
gcgagurngc

SEQ ID NO: 568 - RNA, 10 nt, Artificial Sequence
  intronic recognition element for splicing modifier (REMS)
  misc_feature (8)..(8): n is a, c, g, or u
ucgagurngc

SEQ ID NO: 569 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngagurngc

SEQ ID NO: 570 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggagurngc

SEQ ID NO: 571 - RNA, 10 nt, Artificial Sequence
  intronic recognition element for splicing modifier (REMS)
  misc_feature (8)..(8): n is a, c, g, or u
aggagurngc

SEQ ID NO: 572 - RNA, 10 nt, Artificial Sequence
  intronic recognition element for splicing modifier (REMS)
  misc_feature (8)..(8): n is a, c, g, or u
cggagurngc

SEQ ID NO: 573 - RNA, 10 nt, Artificial Sequence
  intronic recognition element for splicing modifier (REMS)
  misc_feature (8)..(8): n is a, c, g, or u
gggagurngc

SEQ ID NO: 574 - RNA, 10 nt, Artificial Sequence
  intronic recognition element for splicing modifier (REMS)
  misc_feature (8)..(8): n is a, c, g, or u
uggagurngc

SEQ ID NO: 575 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungagurngc

SEQ ID NO: 576 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugagurngc

SEQ ID NO: 577 - RNA, 10 nt, Artificial Sequence
  intronic recognition element for splicing modifier (REMS)
  misc_feature (8)..(8): n is a, c, g, or u
augagurngc

SEQ ID NO: 578 - RNA, 10 nt, Artificial Sequence
  intronic recognition element for splicing modifier (REMS)
  misc_feature (8)..(8): n is a, c, g, or u
cugagurngc

SEQ ID NO: 579 - RNA, 10 nt, Artificial Sequence
  intronic recognition element for splicing modifier (REMS)
  misc_feature (8)..(8): n is a, c, g, or u
gugagurngc

SEQ ID NO: 580 - RNA, 10 nt, Artificial Sequence
  intronic recognition element for splicing modifier (REMS)
  misc_feature (8)..(8): n is a, c, g, or u
uugagurngc

SEQ ID NO: 581 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angagurngg

SEQ ID NO: 582 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagagurngg

SEQ ID NO: 583 - RNA, 10 nt, Artificial Sequence
  intronic recognition element for splicing modifier (REMS)
  misc_feature (8)..(8): n is a, c, g, or u
aagagurngg

SEQ ID NO: 584 - RNA, 10 nt, Artificial Sequence
  intronic recognition element for splicing modifier (REMS)
  misc_feature (8)..(8): n is a, c, g, or u
cagagurngg

SEQ ID NO: 585 - RNA, 10 nt, Artificial Sequence
  intronic recognition element for splicing modifier (REMS)
  misc_feature (8)..(8): n is a, c, g, or u
gagagurngg

SEQ ID NO: 586 - RNA, 10 nt, Artificial Sequence
  intronic recognition element for splicing modifier (REMS)
  misc_feature (8)..(8): n is a, c, g, or u
uagagurngg

SEQ ID NO: 587 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngagurngg

SEQ ID NO: 588 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgagurngg

SEQ ID NO: 589 - RNA, 10 nt, Artificial Sequence
  intronic recognition element for splicing modifier (REMS)
  misc_feature (8)..(8): n is a, c, g, or u
acgagurngg

SEQ ID NO: 590 - RNA, 10 nt, Artificial Sequence
  intronic recognition element for splicing modifier (REMS)
  misc_feature (8)..(8): n is a, c, g, or u
ccgagurngg

SEQ ID NO: 591 - RNA, 10 nt, Artificial Sequence
  intronic recognition element for splicing modifier (REMS)
  misc_feature (8)..(8): n is a, c, g, or u
gcgagurngg

SEQ ID NO: 592 - RNA, 10 nt, Artificial Sequence
  intronic recognition element for splicing modifier (REMS)
  misc_feature (8)..(8): n is a, c, g, or u
ucgagurngg

SEQ ID NO: 593 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngagurngg

SEQ ID NO: 594 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggagurngg

SEQ ID NO: 595 - RNA, 10 nt, Artificial Sequence
  intronic recognition element for splicing modifier (REMS)
  misc_feature (8)..(8): n is a, c, g, or u
aggagurngg

SEQ ID NO: 596 - RNA, 10 nt, Artificial Sequence
  intronic recognition element for splicing modifier (REMS)
  misc_feature (8)..(8): n is a, c, g, or u
cggagurngg

SEQ ID NO: 597 - RNA, 10 nt, Artificial Sequence
  intronic recognition element for splicing modifier (REMS)
  misc_feature (8)..(8): n is a, c, g, or u
gggagurngg

SEQ ID NO: 598 - RNA, 10 nt, Artificial Sequence
  intronic recognition element for splicing modifier (REMS)
  misc_feature (8)..(8): n is a, c, g, or u
uggagurngg

SEQ ID NO: 599 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungagurngg

SEQ ID NO: 600 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugagurngg

SEQ ID NO: 601 - RNA, 10 nt, Artificial Sequence
  intronic recognition element for splicing modifier (REMS)
  misc_feature (8)..(8): n is a, c, g, or u
augagurngg

SEQ ID NO: 602 - RNA, 10 nt, Artificial Sequence
  intronic recognition element for splicing modifier (REMS)
  misc_feature (8)..(8): n is a, c, g, or u
cugagurngg

SEQ ID NO: 603 - RNA, 10 nt, Artificial Sequence
  intronic recognition element for splicing modifier (REMS)
  misc_feature (8)..(8): n is a, c, g, or u
gugagurngg

SEQ ID NO: 604 - RNA, 10 nt, Artificial Sequence
  intronic recognition element for splicing modifier (REMS)
  misc_feature (8)..(8): n is a, c, g, or u
uugagurngg

SEQ ID NO: 605 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angagurngu

SEQ ID NO: 606 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagagurngu

SEQ ID NO: 607 - RNA, 10 nt, Artificial Sequence
  intronic recognition element for splicing modifier (REMS)
  misc_feature (8)..(8): n is a, c, g, or u
aagagurngu

SEQ ID NO: 608 - RNA, 10 nt, Artificial Sequence
  intronic recognition element for splicing modifier (REMS)
  misc_feature (8)..(8): n is a, c, g, or u
cagagurngu

SEQ ID NO: 609 - RNA, 10 nt, Artificial Sequence
  intronic recognition element for splicing modifier (REMS)
  misc_feature (8)..(8): n is a, c, g, or u
gagagurngu

SEQ ID NO: 610 - RNA, 10 nt, Artificial Sequence
  intronic recognition element for splicing modifier (REMS)
  misc_feature (8)..(8): n is a, c, g, or u
uagagurngu

SEQ ID NO: 611 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngagurngu

SEQ ID NO: 612 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgagurngu

SEQ ID NO: 613 - RNA, 10 nt, Artificial Sequence
  intronic recognition element for splicing modifier (REMS)
  misc_feature (8)..(8): n is a, c, g, or u
acgagurngu

SEQ ID NO: 614 - RNA, 10 nt, Artificial Sequence
  intronic recognition element for splicing modifier (REMS)
  misc_feature (8)..(8): n is a, c, g, or u
ccgagurngu

SEQ ID NO: 615 - RNA, 10 nt, Artificial Sequence
  intronic recognition element for splicing modifier (REMS)
  misc_feature (8)..(8): n is a, c, g, or u
gcgagurngu

SEQ ID NO: 616 - RNA, 10 nt, Artificial Sequence
  intronic recognition element for splicing modifier (REMS)
  misc_feature (8)..(8): n is a, c, g, or u
ucgagurngu

SEQ ID NO: 617 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngagurngu

SEQ ID NO: 618 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggagurngu

SEQ ID NO: 619 - RNA, 10 nt, Artificial Sequence
  intronic recognition element for splicing modifier (REMS)
  misc_feature (8)..(8): n is a, c, g, or u
aggagurngu

SEQ ID NO: 620 - RNA, 10 nt, Artificial Sequence
  intronic recognition element for splicing modifier (REMS)
  misc_feature (8)..(8): n is a, c, g, or u
cggagurngu

SEQ ID NO: 621 - RNA, 10 nt, Artificial Sequence
  intronic recognition element for splicing modifier (REMS)
  misc_feature (8)..(8): n is a, c, g, or u
gggagurngu

SEQ ID NO: 622 - RNA, 10 nt, Artificial Sequence
  intronic recognition element for splicing modifier (REMS)
  misc_feature (8)..(8): n is a, c, g, or u
uggagurngu

SEQ ID NO: 623 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungagurngu

SEQ ID NO: 624 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugagurngu

SEQ ID NO: 625 - RNA, 10 nt, Artificial Sequence
  intronic recognition element for splicing modifier (REMS)
  misc_feature (8)..(8): n is a, c, g, or u
augagurngu

SEQ ID NO: 626 - RNA, 10 nt, Artificial Sequence
  intronic recognition element for splicing modifier (REMS)
  misc_feature (8)..(8): n is a, c, g, or u
cugagurngu

SEQ ID NO: 627 - RNA, 10 nt, Artificial Sequence
  intronic recognition element for splicing modifier (REMS)
  misc_feature (8)..(8): n is a, c, g, or u
gugagurngu

SEQ ID NO: 628 - RNA, 10 nt, Artificial Sequence
  intronic recognition element for splicing modifier (REMS)
  misc_feature (8)..(8): n is a, c, g, or u
uugagurngu

SEQ ID NO: 629 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
angaguangn

SEQ ID NO: 630 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nagaguangn

SEQ ID NO: 631 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
aagaguangn

SEQ ID NO: 632 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cagaguangn

SEQ ID NO: 633 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gagaguangn

SEQ ID NO: 634 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uagaguangn

SEQ ID NO: 635 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
cngaguangn

SEQ ID NO: 636 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
ncgaguangn

SEQ ID NO: 637 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
acgaguangn

SEQ ID NO: 638 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
ccgaguangn

SEQ ID NO: 639 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gcgaguangn

SEQ ID NO: 640 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
ucgaguangn

SEQ ID NO: 641 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
gngaguangn

SEQ ID NO: 642 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nggaguangn

SEQ ID NO: 643 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
aggaguangn

SEQ ID NO: 644 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cggaguangn

SEQ ID NO: 645 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gggaguangn

SEQ ID NO: 646 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uggaguangn

SEQ ID NO: 647 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
ungaguangn

SEQ ID NO: 648 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nugaguangn

SEQ ID NO: 649 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
augaguangn

SEQ ID NO: 650 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cugaguangn

SEQ ID NO: 651 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gugaguangn

SEQ ID NO: 652 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uugaguangn

SEQ ID NO: 653 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angaguaagn

SEQ ID NO: 654 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagaguaagn

SEQ ID NO: 655 - RNA, 10 nt, Artificial Sequence
  intronic recognition element for splicing modifier (REMS)
  misc_feature (10)..(10): n is a, c, g, or u
aagaguaagn

SEQ ID NO: 656 - RNA, 10 nt, Artificial Sequence
  intronic recognition element for splicing modifier (REMS)
  misc_feature (10)..(10): n is a, c, g, or u
cagaguaagn

SEQ ID NO: 657 - RNA, 10 nt, Artificial Sequence
  intronic recognition element for splicing modifier (REMS)
  misc_feature (10)..(10): n is a, c, g, or u
gagaguaagn

SEQ ID NO: 658 - RNA, 10 nt, Artificial Sequence
  intronic recognition element for splicing modifier (REMS)
  misc_feature (10)..(10): n is a, c, g, or u
uagaguaagn

SEQ ID NO: 659 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngaguaagn

SEQ ID NO: 660 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgaguaagn

SEQ ID NO: 661 - RNA, 10 nt, Artificial Sequence
  intronic recognition element for splicing modifier (REMS)
  misc_feature (10)..(10): n is a, c, g, or u
acgaguaagn

SEQ ID NO: 662 - RNA, 10 nt, Artificial Sequence
  intronic recognition element for splicing modifier (REMS)
  misc_feature (10)..(10): n is a, c, g, or u
ccgaguaagn

SEQ ID NO: 663 - RNA, 10 nt, Artificial Sequence
  intronic recognition element for splicing modifier (REMS)
  misc_feature (10)..(10): n is a, c, g, or u
gcgaguaagn

SEQ ID NO: 664 - RNA, 10 nt, Artificial Sequence
  intronic recognition element for splicing modifier (REMS)
  misc_feature (10)..(10): n is a, c, g, or u
ucgaguaagn

SEQ ID NO: 665 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngaguaagn

SEQ ID NO: 666 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggaguaagn

SEQ ID NO: 667 - RNA, 10 nt, Artificial Sequence
  intronic recognition element for splicing modifier (REMS)
  misc_feature (10)..(10): n is a, c, g, or u
aggaguaagn

SEQ ID NO: 668 - RNA, 10 nt, Artificial Sequence
  intronic recognition element for splicing modifier (REMS)
  misc_feature (10)..(10): n is a, c, g, or u
cggaguaagn

SEQ ID NO: 669 - RNA, 10 nt, Artificial Sequence
  intronic recognition element for splicing modifier (REMS)
  misc_feature (10)..(10): n is a, c, g, or u
gggaguaagn

SEQ ID NO: 670 - RNA, 10 nt, Artificial Sequence
  intronic recognition element for splicing modifier (REMS)
  misc_feature (10)..(10): n is a, c, g, or u
uggaguaagn

SEQ ID NO: 671 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungaguaagn

SEQ ID NO: 672 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugaguaagn

SEQ ID NO: 673 - RNA, 10 nt, Artificial Sequence
  intronic recognition element for splicing modifier (REMS)
  misc_feature (10)..(10): n is a, c, g, or u
augaguaagn

SEQ ID NO: 674 - RNA, 10 nt, Artificial Sequence
  intronic recognition element for splicing modifier (REMS)
  misc_feature (10)..(10): n is a, c, g, or u
cugaguaagn

SEQ ID NO: 675 - RNA, 10 nt, Artificial Sequence
  intronic recognition element for splicing modifier (REMS)
  misc_feature (10)..(10): n is a, c, g, or u
gugaguaagn

SEQ ID NO: 676 - RNA, 10 nt, Artificial Sequence
  intronic recognition element for splicing modifier (REMS)
  misc_feature (10)..(10): n is a, c, g, or u
uugaguaagn

SEQ ID NO: 677 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angaguacgn

SEQ ID NO: 678 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagaguacgn

SEQ ID NO: 679 - RNA, 10 nt, Artificial Sequence
  intronic recognition element for splicing modifier (REMS)
  misc_feature (10)..(10): n is a, c, g, or u
aagaguacgn

SEQ ID NO: 680 - RNA, 10 nt, Artificial Sequence
  intronic recognition element for splicing modifier (REMS)
  misc_feature (10)..(10): n is a, c, g, or u
cagaguacgn

SEQ ID NO: 681 - RNA, 10 nt, Artificial Sequence
  intronic recognition element for splicing modifier (REMS)
  misc_feature (10)..(10): n is a, c, g, or u
gagaguacgn

SEQ ID NO: 682 - RNA, 10 nt, Artificial Sequence
  intronic recognition element for splicing modifier (REMS)
  misc_feature (10)..(10): n is a, c, g, or u
uagaguacgn

SEQ ID NO: 683 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngaguacgn

SEQ ID NO: 684 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgaguacgn

SEQ ID NO: 685 - RNA, 10 nt, Artificial Sequence
  intronic recognition element for splicing modifier (REMS)
  misc_feature (10)..(10): n is a, c, g, or u
acgaguacgn

SEQ ID NO: 686 - RNA, 10 nt, Artificial Sequence
  intronic recognition element for splicing modifier (REMS)
  misc_feature (10)..(10): n is a, c, g, or u
ccgaguacgn

SEQ ID NO: 687 - RNA, 10 nt, Artificial Sequence
  intronic recognition element for splicing modifier (REMS)
  misc_feature (10)..(10): n is a, c, g, or u
gcgaguacgn

SEQ ID NO: 688 - RNA, 10 nt, Artificial Sequence
  intronic recognition element for splicing modifier (REMS)
  misc_feature (10)..(10): n is a, c, g, or u
ucgaguacgn

SEQ ID NO: 689 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngaguacgn

SEQ ID NO: 690 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggaguacgn

SEQ ID NO: 691 - RNA, 10 nt, Artificial Sequence
  intronic recognition element for splicing modifier (REMS)
  misc_feature (10)..(10): n is a, c, g, or u
aggaguacgn

SEQ ID NO: 692 - RNA, 10 nt, Artificial Sequence
  intronic recognition element for splicing modifier (REMS)
  misc_feature (10)..(10): n is a, c, g, or u
cggaguacgn

SEQ ID NO: 693 - RNA, 10 nt, Artificial Sequence
  intronic recognition element for splicing modifier (REMS)
  misc_feature (10)..(10): n is a, c, g, or u
gggaguacgn

SEQ ID NO: 694 - RNA, 10 nt, Artificial Sequence
  intronic recognition element for splicing modifier (REMS)
  misc_feature (10)..(10): n is a, c, g, or u
uggaguacgn

SEQ ID NO: 695 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungaguacgn

SEQ ID NO: 696 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugaguacgn

SEQ ID NO: 697 - RNA, 10 nt, Artificial Sequence
  intronic recognition element for splicing modifier (REMS)
  misc_feature (10)..(10): n is a, c, g, or u
augaguacgn

SEQ ID NO: 698 - RNA, 10 nt, Artificial Sequence
  intronic recognition element for splicing modifier (REMS)
  misc_feature (10)..(10): n is a, c, g, or u
cugaguacgn

SEQ ID NO: 699 - RNA, 10 nt, Artificial Sequence
  intronic recognition element for splicing modifier (REMS)
  misc_feature (10)..(10): n is a, c, g, or u
gugaguacgn

SEQ ID NO: 700 - RNA, 10 nt, Artificial Sequence
  intronic recognition element for splicing modifier (REMS)
  misc_feature (10)..(10): n is a, c, g, or u
uugaguacgn

SEQ ID NO: 701 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angaguaggn

SEQ ID NO: 702 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagaguaggn

SEQ ID NO: 703 - RNA, 10 nt, Artificial Sequence
  intronic recognition element for splicing modifier (REMS)
  misc_feature (10)..(10): n is a, c, g, or u
aagaguaggn

SEQ ID NO: 704 - RNA, 10 nt, Artificial Sequence
  intronic recognition element for splicing modifier (REMS)
  misc_feature (10)..(10): n is a, c, g, or u
cagaguaggn

SEQ ID NO: 705 - RNA, 10 nt, Artificial Sequence
  intronic recognition element for splicing modifier (REMS)
  misc_feature (10)..(10): n is a, c, g, or u
gagaguaggn

SEQ ID NO: 706 - RNA, 10 nt, Artificial Sequence
  intronic recognition element for splicing modifier (REMS)
  misc_feature (10)..(10): n is a, c, g, or u
uagaguaggn

SEQ ID NO: 707 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngaguaggn

SEQ ID NO: 708 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgaguaggn

SEQ ID NO: 709 - RNA, 10 nt, Artificial Sequence
  intronic recognition element for splicing modifier (REMS)
  misc_feature (10)..(10): n is a, c, g, or u
acgaguaggn

SEQ ID NO: 710 - RNA, 10 nt, Artificial Sequence
  intronic recognition element for splicing modifier (REMS)
  misc_feature (10)..(10): n is a, c, g, or u
ccgaguaggn

SEQ ID NO: 711 - RNA, 10 nt, Artificial Sequence
  intronic recognition element for splicing modifier (REMS)
  misc_feature (10)..(10): n is a, c, g, or u
gcgaguaggn

SEQ ID NO: 712 - RNA, 10 nt, Artificial Sequence
  intronic recognition element for splicing modifier (REMS)
  misc_feature (10)..(10): n is a, c, g, or u
ucgaguaggn

SEQ ID NO: 713 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngaguaggn

SEQ ID NO: 714 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggaguaggn

SEQ ID NO: 715 - RNA, 10 nt, Artificial Sequence
  intronic recognition element for splicing modifier (REMS)
  misc_feature (10)..(10): n is a, c, g, or u
aggaguaggn

SEQ ID NO: 716 - RNA, 10 nt, Artificial Sequence
  intronic recognition element for splicing modifier (REMS)
  misc_feature (10)..(10): n is a, c, g, or u
cggaguaggn

SEQ ID NO: 717 - RNA, 10 nt, Artificial Sequence
  intronic recognition element for splicing modifier (REMS)
  misc_feature (10)..(10): n is a, c, g, or u
gggaguaggn

SEQ ID NO: 718 - RNA, 10 nt, Artificial Sequence
  intronic recognition element for splicing modifier (REMS)
  misc_feature (10)..(10): n is a, c, g, or u
uggaguaggn

SEQ ID NO: 719 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungaguaggn

SEQ ID NO: 720 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugaguaggn

SEQ ID NO: 721 - RNA, 10 nt, Artificial Sequence
  intronic recognition element for splicing modifier (REMS)
  misc_feature (10)..(10): n is a, c, g, or u
augaguaggn

SEQ ID NO: 722 - RNA, 10 nt, Artificial Sequence
  intronic recognition element for splicing modifier (REMS)
  misc_feature (10)..(10): n is a, c, g, or u
cugaguaggn

SEQ ID NO: 723 - RNA, 10 nt, Artificial Sequence
  intronic recognition element for splicing modifier (REMS)
  misc_feature (10)..(10): n is a, c, g, or u
gugaguaggn

SEQ ID NO: 724 - RNA, 10 nt, Artificial Sequence
  intronic recognition element for splicing modifier (REMS)
  misc_feature (10)..(10): n is a, c, g, or u
uugaguaggn

SEQ ID NO: 725 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angaguaugn

SEQ ID NO: 726 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagaguaugn

SEQ ID NO: 727 - RNA, 10 nt, Artificial Sequence
  intronic recognition element for splicing modifier (REMS)
  misc_feature (10)..(10): n is a, c, g, or u
aagaguaugn

SEQ ID NO: 728 - RNA, 10 nt, Artificial Sequence
  intronic recognition element for splicing modifier (REMS)
  misc_feature (10)..(10): n is a, c, g, or u
cagaguaugn

SEQ ID NO: 729 - RNA, 10 nt, Artificial Sequence
  intronic recognition element for splicing modifier (REMS)
  misc_feature (10)..(10): n is a, c, g, or u
gagaguaugn

SEQ ID NO: 730 - RNA, 10 nt, Artificial Sequence
  intronic recognition element for splicing modifier (REMS)
  misc_feature (10)..(10): n is a, c, g, or u
uagaguaugn

SEQ ID NO: 731 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngaguaugn

SEQ ID NO: 732 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgaguaugn

SEQ ID NO: 733 - RNA, 10 nt, Artificial Sequence
  intronic recognition element for splicing modifier (REMS)
  misc_feature (10)..(10): n is a, c, g, or u
acgaguaugn

SEQ ID NO: 734 - RNA, 10 nt, Artificial Sequence
  intronic recognition element for splicing modifier (REMS)
  misc_feature (10)..(10): n is a, c, g, or u
ccgaguaugn

SEQ ID NO: 735 - RNA, 10 nt, Artificial Sequence
  intronic recognition element for splicing modifier (REMS)
  misc_feature (10)..(10): n is a, c, g, or u
gcgaguaugn

SEQ ID NO: 736 - RNA, 10 nt, Artificial Sequence
  intronic recognition element for splicing modifier (REMS)
  misc_feature (10)..(10): n is a, c, g, or u
ucgaguaugn

SEQ ID NO: 737 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngaguaugn

SEQ ID NO: 738 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggaguaugn

SEQ ID NO: 739 - RNA, 10 nt, Artificial Sequence
  intronic recognition element for splicing modifier (REMS)
  misc_feature (10)..(10): n is a, c, g, or u
aggaguaugn

SEQ ID NO: 740 - RNA, 10 nt, Artificial Sequence
  intronic recognition element for splicing modifier (REMS)
  misc_feature (10)..(10): n is a, c, g, or u
cggaguaugn

SEQ ID NO: 741 - RNA, 10 nt, Artificial Sequence
  intronic recognition element for splicing modifier (REMS)
  misc_feature (10)..(10): n is a, c, g, or u
gggaguaugn

SEQ ID NO: 742 - RNA, 10 nt, Artificial Sequence
  intronic recognition element for splicing modifier (REMS)
  misc_feature (10)..(10): n is a, c, g, or u
uggaguaugn

SEQ ID NO: 743 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungaguaugn

SEQ ID NO: 744 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugaguaugn

SEQ ID NO: 745 - RNA, 10 nt, Artificial Sequence
  intronic recognition element for splicing modifier (REMS)
  misc_feature (10)..(10): n is a, c, g, or u
augaguaugn

SEQ ID NO: 746 - RNA, 10 nt, Artificial Sequence
  intronic recognition element for splicing modifier (REMS)
  misc_feature (10)..(10): n is a, c, g, or u
cugaguaugn

SEQ ID NO: 747 - RNA, 10 nt, Artificial Sequence
  intronic recognition element for splicing modifier (REMS)
  misc_feature (10)..(10): n is a, c, g, or u
gugaguaugn

SEQ ID NO: 748 - RNA, 10 nt, Artificial Sequence
  intronic recognition element for splicing modifier (REMS)
  misc_feature (10)..(10): n is a, c, g, or u
uugaguaugn

SEQ ID NO: 749 - RNA, 10 nt, Artificial Sequence
  intronic recognition element for splicing modifier (REMS)
  misc_feature (2)..(2): n is a, c, g, or u
angaguaaga

SEQ ID NO: 750 - RNA, 10 nt, Artificial Sequence
  intronic recognition element for splicing modifier (REMS)
  misc_feature (1)..(1): n is a, c, g, or u
nagaguaaga

SEQ ID NO: 751 - RNA, 10 nt, Artificial Sequence
  intronic recognition element for splicing modifier (REMS)
aagaguaaga

SEQ ID NO: 752 - RNA, 10 nt, Artificial Sequence
  intronic recognition element for splicing modifier (REMS)
cagaguaaga

SEQ ID NO: 753 - RNA, 10 nt, Artificial Sequence
  intronic recognition element for splicing modifier (REMS)
gagaguaaga

SEQ ID NO: 754 - RNA, 10 nt, Artificial Sequence
  intronic recognition element for splicing modifier (REMS)
uagaguaaga

SEQ ID NO: 755 - RNA, 10 nt, Artificial Sequence
  intronic recognition element for splicing modifier (REMS)
  misc_feature (2)..(2): n is a, c, g, or u
cngaguaaga

SEQ ID NO: 756 - RNA, 10 nt, Artificial Sequence
  intronic recognition element for splicing modifier (REMS)
  misc_feature (1)..(1): n is a, c, g, or u
ncgaguaaga

SEQ ID NO: 757 - RNA, 10 nt, Artificial Sequence
  intronic recognition element for splicing modifier (REMS)
acgaguaaga

SEQ ID NO: 758 - RNA, 10 nt, Artificial Sequence
  intronic recognition element for splicing modifier (REMS)
ccgaguaaga

SEQ ID NO: 759 - RNA, 10 nt, Artificial Sequence
  intronic recognition element for splicing modifier (REMS)
gcgaguaaga

SEQ ID NO: 760 - RNA, 10 nt, Artificial Sequence
  intronic recognition element for splicing modifier (REMS)
ucgaguaaga

SEQ ID NO: 761 - RNA, 10 nt, Artificial Sequence
  intronic recognition element for splicing modifier (REMS)
  misc_feature (2)..(2): n is a, c, g, or u
gngaguaaga

SEQ ID NO: 762 - RNA, 10 nt, Artificial Sequence
  intronic recognition element for splicing modifier (REMS)
  misc_feature (1)..(1): n is a, c, g, or u
nggaguaaga

SEQ ID NO: 763 - RNA, 10 nt, Artificial Sequence
  intronic recognition element for splicing modifier (REMS)
aggaguaaga

SEQ ID NO: 764 - RNA, 10 nt, Artificial Sequence
  intronic recognition element for splicing modifier (REMS)
cggaguaaga

SEQ ID NO: 765 - RNA, 10 nt, Artificial Sequence
  intronic recognition element for splicing modifier (REMS)
gggaguaaga

SEQ ID NO: 766 - RNA, 10 nt, Artificial Sequence
  intronic recognition element for splicing modifier (REMS)
uggaguaaga

SEQ ID NO: 767 - RNA, 10 nt, Artificial Sequence
  intronic recognition element for splicing modifier (REMS)
  misc_feature (2)..(2): n is a, c, g, or u
ungaguaaga

SEQ ID NO: 768 - RNA, 10 nt, Artificial Sequence
  intronic recognition element for splicing modifier (REMS)
  misc_feature (1)..(1): n is a, c, g, or u
nugaguaaga

SEQ ID NO: 769 - RNA, 10 nt, Artificial Sequence
  intronic recognition element for splicing modifier (REMS)
augaguaaga

SEQ ID NO: 770 - RNA, 10 nt, Artificial Sequence
  intronic recognition element for splicing modifier (REMS)
cugaguaaga

SEQ ID NO: 771 - RNA, 10 nt, Artificial Sequence
  intronic recognition element for splicing modifier (REMS)
gugaguaaga

SEQ ID NO: 772 - RNA, 10 nt, Artificial Sequence
  intronic recognition element for splicing modifier (REMS)
uugaguaaga

SEQ ID NO: 773 - RNA, 10 nt, Artificial Sequence
  intronic recognition element for splicing modifier (REMS)
  misc_feature (2)..(2): n is a, c, g, or u
angaguacga

SEQ ID NO: 774 - RNA, 10 nt, Artificial Sequence
  intronic recognition element for splicing modifier (REMS)
  misc_feature (1)..(1): n is a, c, g, or u
nagaguacga

SEQ ID NO: 775 - RNA, 10 nt, Artificial Sequence
  intronic recognition element for splicing modifier (REMS)
aagaguacga

SEQ ID NO: 776 - RNA, 10 nt, Artificial Sequence
  intronic recognition element for splicing modifier (REMS)
cagaguacga

SEQ ID NO: 777 - RNA, 10 nt, Artificial Sequence
  intronic recognition element for splicing modifier (REMS)
gagaguacga

SEQ ID NO: 778 - RNA, 10 nt, Artificial Sequence
  intronic recognition element for splicing modifier (REMS)
uagaguacga

SEQ ID NO: 779 - RNA, 10 nt, Artificial Sequence
  intronic recognition element for splicing modifier (REMS)
  misc_feature (2)..(2): n is a, c, g, or u
cngaguacga

SEQ ID NO: 780 - RNA, 10 nt, Artificial Sequence
  intronic recognition element for splicing modifier (REMS)
  misc_feature (1)..(1): n is a, c, g, or u
ncgaguacga

SEQ ID NO: 781 - RNA, 10 nt, Artificial Sequence
  intronic recognition element for splicing modifier (REMS)
acgaguacga

SEQ ID NO: 782 - RNA, 10 nt, Artificial Sequence
  intronic recognition element for splicing modifier (REMS)
ccgaguacga

SEQ ID NO: 783 - RNA, 10 nt, Artificial Sequence
  intronic recognition element for splicing modifier (REMS)
gcgaguacga

SEQ ID NO: 784 - RNA, 10 nt, Artificial Sequence
  intronic recognition element for splicing modifier (REMS)
ucgaguacga

SEQ ID NO: 785 - RNA, 10 nt, Artificial Sequence
  intronic recognition element for splicing modifier (REMS)
  misc_feature (2)..(2): n is a, c, g, or u
gngaguacga

SEQ ID NO: 786 - RNA, 10 nt, Artificial Sequence
  intronic recognition element for splicing modifier (REMS)
  misc_feature (1)..(1): n is a, c, g, or u
nggaguacga

SEQ ID NO: 787 - RNA, 10 nt, Artificial Sequence
  intronic recognition element for splicing modifier (REMS)
aggaguacga

SEQ ID NO: 788 - RNA, 10 nt, Artificial Sequence
  intronic recognition element for splicing modifier (REMS)
cggaguacga

SEQ ID NO: 789 - RNA, 10 nt, Artificial Sequence
  intronic recognition element for splicing modifier (REMS)
gggaguacga

SEQ ID NO: 790 - RNA, 10 nt, Artificial Sequence
  intronic recognition element for splicing modifier (REMS)
uggaguacga

SEQ ID NO: 791 - RNA, 10 nt, Artificial Sequence
  intronic recognition element for splicing modifier (REMS)
  misc_feature (2)..(2): n is a, c, g, or u
ungaguacga

SEQ ID NO: 792 - RNA, 10 nt, Artificial Sequence
  intronic recognition element for splicing modifier (REMS)
  misc_feature (1)..(1): n is a, c, g, or u
nugaguacga

SEQ ID NO: 793 - RNA, 10 nt, Artificial Sequence
  intronic recognition element for splicing modifier (REMS)
augaguacga

SEQ ID NO: 794 - RNA, 10 nt, Artificial Sequence
  intronic recognition element for splicing modifier (REMS)
cugaguacga

SEQ ID NO: 795 - RNA, 10 nt, Artificial Sequence
  intronic recognition element for splicing modifier (REMS)
gugaguacga

SEQ ID NO: 796 - RNA, 10 nt, Artificial Sequence
  intronic recognition element for splicing modifier (REMS)
uugaguacga

SEQ ID NO: 797 - RNA, 10 nt, Artificial Sequence
  intronic recognition element for splicing modifier (REMS)
  misc_feature (2)..(2): n is a, c, g, or u
angaguagga

SEQ ID NO: 798 - RNA, 10 nt, Artificial Sequence
  intronic recognition element for splicing modifier (REMS)
  misc_feature (1)..(1): n is a, c, g, or u
nagaguagga

SEQ ID NO: 799 - RNA, 10 nt, Artificial Sequence
  intronic recognition element for splicing modifier (REMS)
aagaguagga

SEQ ID NO: 800 - RNA, 10 nt, Artificial Sequence
  intronic recognition element for splicing modifier (REMS)
cagaguagga

SEQ ID NO: 801 - RNA, 10 nt, Artificial Sequence
  intronic recognition element for splicing modifier (REMS)
gagaguagga

SEQ ID NO: 802 - RNA, 10 nt, Artificial Sequence
  intronic recognition element for splicing modifier (REMS)
uagaguagga

SEQ ID NO: 803 - RNA, 10 nt, Artificial Sequence
  intronic recognition element for splicing modifier (REMS)
  misc_feature (2)..(2): n is a, c, g, or u
cngaguagga

SEQ ID NO: 804 - RNA, 10 nt, Artificial Sequence
  intronic recognition element for splicing modifier (REMS)
  misc_feature (1)..(1): n is a, c, g, or u
ncgaguagga

SEQ ID NO: 805 - RNA, 10 nt, Artificial Sequence
  intronic recognition element for splicing modifier (REMS)
acgaguagga

SEQ ID NO: 806 - RNA, 10 nt, Artificial Sequence
  intronic recognition element for splicing modifier (REMS)
ccgaguagga

SEQ ID NO: 807 - RNA, 10 nt, Artificial Sequence
  intronic recognition element for splicing modifier (REMS)
gcgaguagga

SEQ ID NO: 808 - RNA, 10 nt, Artificial Sequence
  intronic recognition element for splicing modifier (REMS)
ucgaguagga

SEQ ID NO: 809 - RNA, 10 nt, Artificial Sequence
  intronic recognition element for splicing modifier (REMS)
  misc_feature (2)..(2): n is a, c, g, or u
gngaguagga

SEQ ID NO: 810 - RNA, 10 nt, Artificial Sequence
  intronic recognition element for splicing modifier (REMS)
  misc_feature (1)..(1): n is a, c, g, or u
nggaguagga

SEQ ID NO: 811 - RNA, 10 nt, Artificial Sequence
  intronic recognition element for splicing modifier (REMS)
aggaguagga

SEQ ID NO: 812 - RNA, 10 nt, Artificial Sequence
  intronic recognition element for splicing modifier (REMS)
cggaguagga

SEQ ID NO: 813 - RNA, 10 nt, Artificial Sequence
  intronic recognition element for splicing modifier (REMS)
gggaguagga

SEQ ID NO: 814 - RNA, 10 nt, Artificial Sequence
  intronic recognition element for splicing modifier (REMS)
uggaguagga

SEQ ID NO: 815 - RNA, 10 nt, Artificial Sequence
  intronic recognition element for splicing modifier (REMS)
  misc_feature (2)..(2): n is a, c, g, or u
ungaguagga

SEQ ID NO: 816 - RNA, 10 nt, Artificial Sequence
  intronic recognition element for splicing modifier (REMS)
  misc_feature (1)..(1): n is a, c, g, or u
nugaguagga

SEQ ID NO: 817 - RNA, 10 nt, Artificial Sequence
  intronic recognition element for splicing modifier (REMS)
augaguagga

SEQ ID NO: 818 - RNA, 10 nt, Artificial Sequence
  intronic recognition element for splicing modifier (REMS)
cugaguagga

SEQ ID NO: 819 - RNA, 10 nt, Artificial Sequence
  intronic recognition element for splicing modifier (REMS)
gugaguagga

SEQ ID NO: 820 - RNA, 10 nt, Artificial Sequence
  intronic recognition element for splicing modifier (REMS)
uugaguagga

SEQ ID NO: 821 - RNA, 10 nt, Artificial Sequence
  intronic recognition element for splicing modifier (REMS)
  misc_feature (2)..(2): n is a, c, g, or u
angaguauga

SEQ ID NO: 822 - RNA, 10 nt, Artificial Sequence
  intronic recognition element for splicing modifier (REMS)
  misc_feature (1)..(1): n is a, c, g, or u
nagaguauga

SEQ ID NO: 823 - RNA, 10 nt, Artificial Sequence
  intronic recognition element for splicing modifier (REMS)
aagaguauga

SEQ ID NO: 824 - RNA, 10 nt, Artificial Sequence
  intronic recognition element for splicing modifier (REMS)
cagaguauga

SEQ ID NO: 825 - RNA, 10 nt, Artificial Sequence
  intronic recognition element for splicing modifier (REMS)
gagaguauga

SEQ ID NO: 826 - RNA, 10 nt, Artificial Sequence
  intronic recognition element for splicing modifier (REMS)
uagaguauga

SEQ ID NO: 827 - RNA, 10 nt, Artificial Sequence
  intronic recognition element for splicing modifier (REMS)
  misc_feature (2)..(2): n is a, c, g, or u
cngaguauga

SEQ ID NO: 828 - RNA, 10 nt, Artificial Sequence
  intronic recognition element for splicing modifier (REMS)
  misc_feature (1)..(1): n is a, c, g, or u
ncgaguauga

SEQ ID NO: 829 - RNA, 10 nt, Artificial Sequence
  intronic recognition element for splicing modifier (REMS)
acgaguauga

SEQ ID NO: 830 - RNA, 10 nt, Artificial Sequence
  intronic recognition element for splicing modifier (REMS)
ccgaguauga

SEQ ID NO: 831 - RNA, 10 nt, Artificial Sequence
  intronic recognition element for splicing modifier (REMS)
gcgaguauga

SEQ ID NO: 832 - RNA, 10 nt, Artificial Sequence
  intronic recognition element for splicing modifier (REMS)
ucgaguauga

SEQ ID NO: 833 - RNA, 10 nt, Artificial Sequence
  intronic recognition element for splicing modifier (REMS)
  misc_feature (2)..(2): n is a, c, g, or u
gngaguauga

SEQ ID NO: 834 - RNA, 10 nt, Artificial Sequence
  intronic recognition element for splicing modifier (REMS)
  misc_feature (1)..(1): n is a, c, g, or u
nggaguauga

SEQ ID NO: 835 - RNA, 10 nt, Artificial Sequence
  intronic recognition element for splicing modifier (REMS)
aggaguauga

SEQ ID NO: 836 - RNA, 10 nt, Artificial Sequence
  intronic recognition element for splicing modifier (REMS)
cggaguauga

SEQ ID NO: 837 - RNA, 10 nt, Artificial Sequence
  intronic recognition element for splicing modifier (REMS)
gggaguauga

SEQ ID NO: 838 - RNA, 10 nt, Artificial Sequence
  intronic recognition element for splicing modifier (REMS)
uggaguauga

SEQ ID NO: 839 - RNA, 10 nt, Artificial Sequence
  intronic recognition element for splicing modifier (REMS)
  misc_feature (2)..(2): n is a, c, g, or u
ungaguauga

SEQ ID NO: 840 - RNA, 10 nt, Artificial Sequence
  intronic recognition element for splicing modifier (REMS)
  misc_feature (1)..(1): n is a, c, g, or u
nugaguauga

SEQ ID NO: 841 - RNA, 10 nt, Artificial Sequence
  intronic recognition element for splicing modifier (REMS)
augaguauga

SEQ ID NO: 842 - RNA, 10 nt, Artificial Sequence
  intronic recognition element for splicing modifier (REMS)
cugaguauga

SEQ ID NO: 843 - RNA, 10 nt, Artificial Sequence
  intronic recognition element for splicing modifier (REMS)
gugaguauga

SEQ ID NO: 844 - RNA, 10 nt, Artificial Sequence
  intronic recognition element for splicing modifier (REMS)
uugaguauga

SEQ ID NO: 845 - RNA, 10 nt, Artificial Sequence
  intronic recognition element for splicing modifier (REMS)
  misc_feature (2)..(2): n is a, c, g, or u
angaguaagc

SEQ ID NO: 846 - RNA, 10 nt, Artificial Sequence
  intronic recognition element for splicing modifier (REMS)
  misc_feature (1)..(1): n is a, c, g, or u
nagaguaagc

SEQ ID NO: 847 - RNA, 10 nt, Artificial Sequence
  intronic recognition element for splicing modifier (REMS)
aagaguaagc

SEQ ID NO: 848 - RNA, 10 nt, Artificial Sequence
  intronic recognition element for splicing modifier (REMS)
cagaguaagc

SEQ ID NO: 849 - RNA, 10 nt, Artificial Sequence
  intronic recognition element for splicing modifier (REMS)
gagaguaagc

SEQ ID NO: 850 - RNA, 10 nt, Artificial Sequence
  intronic recognition element for splicing modifier (REMS)
uagaguaagc

SEQ ID NO: 851 - RNA, 10 nt, Artificial Sequence
  intronic recognition element for splicing modifier (REMS)
  misc_feature (2)..(2): n is a, c, g, or u
cngaguaagc

SEQ ID NO: 852 - RNA, 10 nt, Artificial Sequence
  intronic recognition element for splicing modifier (REMS)
  misc_feature (1)..(1): n is a, c, g, or u
ncgaguaagc

SEQ ID NO: 853 - RNA, 10 nt, Artificial Sequence
  intronic recognition element for splicing modifier (REMS)
acgaguaagc

SEQ ID NO: 854 - RNA, 10 nt, Artificial Sequence
  intronic recognition element for splicing modifier (REMS)
ccgaguaagc

SEQ ID NO: 855 - RNA, 10 nt, Artificial Sequence
  intronic recognition element for splicing modifier (REMS)
gcgaguaagc

SEQ ID NO: 856 - RNA, 10 nt, Artificial Sequence
  intronic recognition element for splicing modifier (REMS)
ucgaguaagc

SEQ ID NO: 857 - RNA, 10 nt, Artificial Sequence
  intronic recognition element for splicing modifier (REMS)
  misc_feature (2)..(2): n is a, c, g, or u
gngaguaagc

SEQ ID NO: 858 - RNA, 10 nt, Artificial Sequence
  intronic recognition element for splicing modifier (REMS)
  misc_feature (1)..(1): n is a, c, g, or u
nggaguaagc

SEQ ID NO: 859 - RNA, 10 nt, Artificial Sequence
  intronic recognition element for splicing modifier (REMS)
aggaguaagc

SEQ ID NO: 860 - RNA, 10 nt, Artificial Sequence
  intronic recognition element for splicing modifier (REMS)
cggaguaagc

SEQ ID NO: 861 - RNA, 10 nt, Artificial Sequence
  intronic recognition element for splicing modifier (REMS)
gggaguaagc

SEQ ID NO: 862 - RNA, 10 nt, Artificial Sequence
  intronic recognition element for splicing modifier (REMS)
uggaguaagc

SEQ ID NO: 863 - RNA, 10 nt, Artificial Sequence
  intronic recognition element for splicing modifier (REMS)
  misc_feature (2)..(2): n is a, c, g, or u
ungaguaagc

SEQ ID NO: 864 - RNA, 10 nt, Artificial Sequence
  intronic recognition element for splicing modifier (REMS)
  misc_feature (1)..(1): n is a, c, g, or u
nugaguaagc

SEQ ID NO: 865 - RNA, 10 nt, Artificial Sequence
  intronic recognition element for splicing modifier (REMS)
augaguaagc

SEQ ID NO: 866 - RNA, 10 nt, Artificial Sequence
  intronic recognition element for splicing modifier (REMS)
cugaguaagc

SEQ ID NO: 867 - RNA, 10 nt, Artificial Sequence
  intronic recognition element for splicing modifier (REMS)
gugaguaagc

SEQ ID NO: 868 - RNA, 10 nt, Artificial Sequence
  intronic recognition element for splicing modifier (REMS)
uugaguaagc

SEQ ID NO: 869 - RNA, 10 nt, Artificial Sequence
  intronic recognition element for splicing modifier (REMS)
  misc_feature (2)..(2): n is a, c, g, or u
angaguacgc

SEQ ID NO: 870 - RNA, 10 nt, Artificial Sequence
  intronic recognition element for splicing modifier (REMS)
  misc_feature (1)..(1): n is a, c, g, or u
nagaguacgc

SEQ ID NO: 871 - RNA, 10 nt, Artificial Sequence
  intronic recognition element for splicing modifier (REMS)
aagaguacgc

SEQ ID NO: 872 - RNA, 10 nt, Artificial Sequence
  intronic recognition element for splicing modifier (REMS)
cagaguacgc

SEQ ID NO: 873 - RNA, 10 nt, Artificial Sequence
  intronic recognition element for splicing modifier (REMS)
gagaguacgc

SEQ ID NO: 874 - RNA, 10 nt, Artificial Sequence
  intronic recognition element for splicing modifier (REMS)
uagaguacgc

SEQ ID NO: 875 - RNA, 10 nt, Artificial Sequence
  intronic recognition element for splicing modifier (REMS)
  misc_feature (2)..(2): n is a, c, g, or u
cngaguacgc

SEQ ID NO: 876 - RNA, 10 nt, Artificial Sequence
  intronic recognition element for splicing modifier (REMS)
  misc_feature (1)..(1): n is a, c, g, or u
ncgaguacgc

SEQ ID NO: 877 - RNA, 10 nt, Artificial Sequence
  intronic recognition element for splicing modifier (REMS)
acgaguacgc

SEQ ID NO: 878 - RNA, 10 nt, Artificial Sequence
  intronic recognition element for splicing modifier (REMS)
ccgaguacgc

SEQ ID NO: 879 - RNA, 10 nt, Artificial Sequence
  intronic recognition element for splicing modifier (REMS)
gcgaguacgc

SEQ ID NO: 880 - RNA, 10 nt, Artificial Sequence
  intronic recognition element for splicing modifier (REMS)
ucgaguacgc

SEQ ID NO: 881 - RNA, 10 nt, Artificial Sequence
  intronic recognition element for splicing modifier (REMS)
  misc_feature (2)..(2): n is a, c, g, or u
gngaguacgc

SEQ ID NO: 882 - RNA, 10 nt, Artificial Sequence
  intronic recognition element for splicing modifier (REMS)
  misc_feature (1)..(1): n is a, c, g, or u
nggaguacgc

SEQ ID NO: 883 - RNA, 10 nt, Artificial Sequence
  intronic recognition element for splicing modifier (REMS)
aggaguacgc

SEQ ID NO: 884 - RNA, 10 nt, Artificial Sequence
  intronic recognition element for splicing modifier (REMS)
cggaguacgc

SEQ ID NO: 885 - RNA, 10 nt, Artificial Sequence
  intronic recognition element for splicing modifier (REMS)
gggaguacgc

SEQ ID NO: 886 - RNA, 10 nt, Artificial Sequence
  intronic recognition element for splicing modifier (REMS)
uggaguacgc

SEQ ID NO: 887 - RNA, 10 nt, Artificial Sequence
  intronic recognition element for splicing modifier (REMS)
  misc_feature (2)..(2): n is a, c, g, or u
ungaguacgc

SEQ ID NO: 888 - RNA, 10 nt, Artificial Sequence
  intronic recognition element for splicing modifier (REMS)
  misc_feature (1)..(1): n is a, c, g, or u
nugaguacgc

SEQ ID NO: 889 - RNA, 10 nt, Artificial Sequence
  intronic recognition element for splicing modifier (REMS)
augaguacgc

SEQ ID NO: 890 - RNA, 10 nt, Artificial Sequence
  intronic recognition element for splicing modifier (REMS)
cugaguacgc

SEQ ID NO: 891 - RNA, 10 nt, Artificial Sequence
  intronic recognition element for splicing modifier (REMS)
gugaguacgc

SEQ ID NO: 892 - RNA, 10 nt, Artificial Sequence
  intronic recognition element for splicing modifier (REMS)
uugaguacgc

SEQ ID NO: 893 - RNA, 10 nt, Artificial Sequence
  intronic recognition element for splicing modifier (REMS)
  misc_feature (2)..(2): n is a, c, g, or u
angaguaggc

SEQ ID NO: 894 - RNA, 10 nt, Artificial Sequence
  intronic recognition element for splicing modifier (REMS)
  misc_feature (1)..(1): n is a, c, g, or u
nagaguaggc

SEQ ID NO: 895 - RNA, 10 nt, Artificial Sequence
  intronic recognition element for splicing modifier (REMS)
aagaguaggc

SEQ ID NO: 896 - RNA, 10 nt, Artificial Sequence
  intronic recognition element for splicing modifier (REMS)
cagaguaggc

SEQ ID NO: 897 - RNA, 10 nt, Artificial Sequence
  intronic recognition element for splicing modifier (REMS)
gagaguaggc

SEQ ID NO: 898 - RNA, 10 nt, Artificial Sequence
  intronic recognition element for splicing modifier (REMS)
uagaguaggc

SEQ ID NO: 899 - RNA, 10 nt, Artificial Sequence
  intronic recognition element for splicing modifier (REMS)
  misc_feature (2)..(2): n is a, c, g, or u
cngaguaggc

SEQ ID NO: 900 - RNA, 10 nt, Artificial Sequence
  intronic recognition element for splicing modifier (REMS)
  misc_feature (1)..(1): n is a, c, g, or u
ncgaguaggc

SEQ ID NO: 901 - RNA, 10 nt, Artificial Sequence
  intronic recognition element for splicing modifier (REMS)
acgaguaggc

SEQ ID NO: 902 - RNA, 10 nt, Artificial Sequence
  intronic recognition element for splicing modifier (REMS)
ccgaguaggc

SEQ ID NO: 903 - RNA, 10 nt, Artificial Sequence
  intronic recognition element for splicing modifier (REMS)
gcgaguaggc

SEQ ID NO: 904 - RNA, 10 nt, Artificial Sequence
  intronic recognition element for splicing modifier (REMS)
ucgaguaggc

SEQ ID NO: 905 - RNA, 10 nt, Artificial Sequence
  intronic recognition element for splicing modifier (REMS)
  misc_feature (2)..(2): n is a, c, g, or u
gngaguaggc

SEQ ID NO: 906 - RNA, 10 nt, Artificial Sequence
  intronic recognition element for splicing modifier (REMS)
  misc_feature (1)..(1): n is a, c, g, or u
nggaguaggc

SEQ ID NO: 907 - RNA, 10 nt, Artificial Sequence
  intronic recognition element for splicing modifier (REMS)
aggaguaggc

SEQ ID NO: 908 - RNA, 10 nt, Artificial Sequence
  intronic recognition element for splicing modifier (REMS)
cggaguaggc

SEQ ID NO: 909 - RNA, 10 nt, Artificial Sequence
  intronic recognition element for splicing modifier (REMS)
gggaguaggc

SEQ ID NO: 910 - RNA, 10 nt, Artificial Sequence
  intronic recognition element for splicing modifier (REMS)
uggaguaggc

SEQ ID NO: 911 - RNA, 10 nt, Artificial Sequence
  intronic recognition element for splicing modifier (REMS)
  misc_feature (2)..(2): n is a, c, g, or u
ungaguaggc

SEQ ID NO: 912 - RNA, 10 nt, Artificial Sequence
  intronic recognition element for splicing modifier (REMS)
  misc_feature (1)..(1): n is a, c, g, or u
nugaguaggc

SEQ ID NO: 913 - RNA, 10 nt, Artificial Sequence
  intronic recognition element for splicing modifier (REMS)
augaguaggc

SEQ ID NO: 914 - RNA, 10 nt, Artificial Sequence
  intronic recognition element for splicing modifier (REMS)
cugaguaggc

SEQ ID NO: 915 - RNA, 10 nt, Artificial Sequence
  intronic recognition element for splicing modifier (REMS)
gugaguaggc

SEQ ID NO: 916 - RNA, 10 nt, Artificial Sequence
  intronic recognition element for splicing modifier (REMS)
uugaguaggc

SEQ ID NO: 917 - RNA, 10 nt, Artificial Sequence
  intronic recognition element for splicing modifier (REMS)
  misc_feature (2)..(2): n is a, c, g, or u
angaguaugc

SEQ ID NO: 918 - RNA, 10 nt, Artificial Sequence
  intronic recognition element for splicing modifier (REMS)
  misc_feature (1)..(1): n is a, c, g, or u
nagaguaugc

SEQ ID NO: 919 - RNA, 10 nt, Artificial Sequence
  intronic recognition element for splicing modifier (REMS)
aagaguaugc

SEQ ID NO: 920 - RNA, 10 nt, Artificial Sequence
  intronic recognition element for splicing modifier (REMS)
cagaguaugc

SEQ ID NO: 921 - RNA, 10 nt, Artificial Sequence
  intronic recognition element for splicing modifier (REMS)
gagaguaugc

SEQ ID NO: 922 - RNA, 10 nt, Artificial Sequence
  intronic recognition element for splicing modifier (REMS)
uagaguaugc

SEQ ID NO: 923 - RNA, 10 nt, Artificial Sequence
  intronic recognition element for splicing modifier (REMS)
  misc_feature (2)..(2): n is a, c, g, or u
cngaguaugc

SEQ ID NO: 924 - RNA, 10 nt, Artificial Sequence
  intronic recognition element for splicing modifier (REMS)
  misc_feature (1)..(1): n is a, c, g, or u
ncgaguaugc

SEQ ID NO: 925 - RNA, 10 nt, Artificial Sequence
  intronic recognition element for splicing modifier (REMS)
acgaguaugc

SEQ ID NO: 926 - RNA, 10 nt, Artificial Sequence
  intronic recognition element for splicing modifier (REMS)
ccgaguaugc

SEQ ID NO: 927 - RNA, 10 nt, Artificial Sequence
  intronic recognition element for splicing modifier (REMS)
gcgaguaugc

SEQ ID NO: 928 - RNA, 10 nt, Artificial Sequence
  intronic recognition element for splicing modifier (REMS)
ucgaguaugc

SEQ ID NO: 929 - RNA, 10 nt, Artificial Sequence
  intronic recognition element for splicing modifier (REMS)
  misc_feature (2)..(2): n is a, c, g, or u
gngaguaugc

SEQ ID NO: 930 - RNA, 10 nt, Artificial Sequence
  intronic recognition element for splicing modifier (REMS)
  misc_feature (1)..(1): n is a, c, g, or u
nggaguaugc

SEQ ID NO: 931 - RNA, 10 nt, Artificial Sequence
  intronic recognition element for splicing modifier (REMS)
aggaguaugc

SEQ ID NO: 932 - RNA, 10 nt, Artificial Sequence
  intronic recognition element for splicing modifier (REMS)
cggaguaugc

SEQ ID NO: 933 - RNA, 10 nt, Artificial Sequence
  intronic recognition element for splicing modifier (REMS)
gggaguaugc

SEQ ID NO: 934 - RNA, 10 nt, Artificial Sequence
  intronic recognition element for splicing modifier (REMS)
uggaguaugc

SEQ ID NO: 935 - RNA, 10 nt, Artificial Sequence
  intronic recognition element for splicing modifier (REMS)
  misc_feature (2)..(2): n is a, c, g, or u
ungaguaugc

SEQ ID NO: 936 - RNA, 10 nt, Artificial Sequence
  intronic recognition element for splicing modifier (REMS)
  misc_feature (1)..(1): n is a, c, g, or u
nugaguaugc

SEQ ID NO: 937 - RNA, 10 nt, Artificial Sequence
  intronic recognition element for splicing modifier (REMS)
augaguaugc

SEQ ID NO: 938 - RNA, 10 nt, Artificial Sequence
  intronic recognition element for splicing modifier (REMS)
cugaguaugc

SEQ ID NO: 939 - RNA, 10 nt, Artificial Sequence
  intronic recognition element for splicing modifier (REMS)
gugaguaugc

SEQ ID NO: 940 - RNA, 10 nt, Artificial Sequence
  intronic recognition element for splicing modifier (REMS)
uugaguaugc

SEQ ID NO: 941 - RNA, 10 nt, Artificial Sequence
  intronic recognition element for splicing modifier (REMS)
  misc_feature (2)..(2): n is a, c, g, or u
angaguaagg

SEQ ID NO: 942 - RNA, 10 nt, Artificial Sequence
  intronic recognition element for splicing modifier (REMS)
  misc_feature (1)..(1): n is a, c, g, or u
nagaguaagg

SEQ ID NO: 943 - RNA, 10 nt, Artificial Sequence
  intronic recognition element for splicing modifier (REMS)
aagaguaagg

SEQ ID NO: 944 - RNA, 10 nt, Artificial Sequence
  intronic recognition element for splicing modifier (REMS)
cagaguaagg

SEQ ID NO: 945 - RNA, 10 nt, Artificial Sequence
  intronic recognition element for splicing modifier (REMS)
gagaguaagg

SEQ ID NO: 946 - RNA, 10 nt, Artificial Sequence
  intronic recognition element for splicing modifier (REMS)
uagaguaagg

SEQ ID NO: 947 - RNA, 10 nt, Artificial Sequence
  intronic recognition element for splicing modifier (REMS)
  misc_feature (2)..(2): n is a, c, g, or u
cngaguaagg

SEQ ID NO: 948 - RNA, 10 nt, Artificial Sequence
  intronic recognition element for splicing modifier (REMS)
  misc_feature (1)..(1): n is a, c, g, or u
ncgaguaagg

SEQ ID NO: 949 - RNA, 10 nt, Artificial Sequence
  intronic recognition element for splicing modifier (REMS)
acgaguaagg

SEQ ID NO: 950 - RNA, 10 nt, Artificial Sequence
  intronic recognition element for splicing modifier (REMS)
ccgaguaagg

SEQ ID NO: 951 - RNA, 10 nt, Artificial Sequence
  intronic recognition element for splicing modifier (REMS)
gcgaguaagg

SEQ ID NO: 952 - RNA, 10 nt, Artificial Sequence
  intronic recognition element for splicing modifier (REMS)
ucgaguaagg

SEQ ID NO: 953 - RNA, 10 nt, Artificial Sequence
  intronic recognition element for splicing modifier (REMS)
  misc_feature (2)..(2): n is a, c, g, or u
gngaguaagg

SEQ ID NO: 954 - RNA, 10 nt, Artificial Sequence
  intronic recognition element for splicing modifier (REMS)
  misc_feature (1)..(1): n is a, c, g, or u
nggaguaagg

SEQ ID NO: 955 - RNA, 10 nt, Artificial Sequence
  intronic recognition element for splicing modifier (REMS)
aggaguaagg

SEQ ID NO: 956 - RNA, 10 nt, Artificial Sequence
  intronic recognition element for splicing modifier (REMS)
cggaguaagg

SEQ ID NO: 957 - RNA, 10 nt, Artificial Sequence
  intronic recognition element for splicing modifier (REMS)
gggaguaagg

SEQ ID NO: 958 - RNA, 10 nt, Artificial Sequence
  intronic recognition element for splicing modifier (REMS)
uggaguaagg

SEQ ID NO: 959 - RNA, 10 nt, Artificial Sequence
  intronic recognition element for splicing modifier (REMS)
  misc_feature (2)..(2): n is a, c, g, or u
ungaguaagg

SEQ ID NO: 960 - RNA, 10 nt, Artificial Sequence
  intronic recognition element for splicing modifier (REMS)
  misc_feature (1)..(1): n is a, c, g, or u
nugaguaagg

SEQ ID NO: 961 - RNA, 10 nt, Artificial Sequence
  intronic recognition element for splicing modifier (REMS)
augaguaagg

SEQ ID NO: 962 - RNA, 10 nt, Artificial Sequence
  intronic recognition element for splicing modifier (REMS)
cugaguaagg

SEQ ID NO: 963 - RNA, 10 nt, Artificial Sequence
  intronic recognition element for splicing modifier (REMS)
gugaguaagg

SEQ ID NO: 964 - RNA, 10 nt, Artificial Sequence
  intronic recognition element for splicing modifier (REMS)
uugaguaagg

SEQ ID NO: 965 - RNA, 10 nt, Artificial Sequence
  intronic recognition element for splicing modifier (REMS)
  misc_feature (2)..(2): n is a, c, g, or u
angaguacgg

SEQ ID NO: 966 - RNA, 10 nt, Artificial Sequence
  intronic recognition element for splicing modifier (REMS)
  misc_feature (1)..(1): n is a, c, g, or u
nagaguacgg

SEQ ID NO: 967 - RNA, 10 nt, Artificial Sequence
  intronic recognition element for splicing modifier (REMS)
aagaguacgg

SEQ ID NO: 968 - RNA, 10 nt, Artificial Sequence
  intronic recognition element for splicing modifier (REMS)
cagaguacgg

SEQ ID NO: 969 - RNA, 10 nt, Artificial Sequence
  intronic recognition element for splicing modifier (REMS)
gagaguacgg

SEQ ID NO: 970 - RNA, 10 nt, Artificial Sequence
  intronic recognition element for splicing modifier (REMS)
uagaguacgg

SEQ ID NO: 971 - RNA, 10 nt, Artificial Sequence
  intronic recognition element for splicing modifier (REMS)
  misc_feature (2)..(2): n is a, c, g, or u
cngaguacgg

SEQ ID NO: 972 - RNA, 10 nt, Artificial Sequence
  intronic recognition element for splicing modifier (REMS)
  misc_feature (1)..(1): n is a, c, g, or u
ncgaguacgg

SEQ ID NO: 973 - RNA, 10 nt, Artificial Sequence
  intronic recognition element for splicing modifier (REMS)
acgaguacgg

SEQ ID NO: 974 - RNA, 10 nt, Artificial Sequence
  intronic recognition element for splicing modifier (REMS)
ccgaguacgg

SEQ ID NO: 975 - RNA, 10 nt, Artificial Sequence
  intronic recognition element for splicing modifier (REMS)
gcgaguacgg

SEQ ID NO: 976 - RNA, 10 nt, Artificial Sequence
  intronic recognition element for splicing modifier (REMS)
ucgaguacgg

SEQ ID NO: 977 - RNA, 10 nt, Artificial Sequence
  intronic recognition element for splicing modifier (REMS)
  misc_feature (2)..(2): n is a, c, g, or u
gngaguacgg

SEQ ID NO: 978 - RNA, 10 nt, Artificial Sequence
  intronic recognition element for splicing modifier (REMS)
  misc_feature (1)..(1): n is a, c, g, or u
nggaguacgg

SEQ ID NO: 979 - RNA, 10 nt, Artificial Sequence
  intronic recognition element for splicing modifier (REMS)
aggaguacgg

SEQ ID NO: 980 - RNA, 10 nt, Artificial Sequence
  intronic recognition element for splicing modifier (REMS)
cggaguacgg

SEQ ID NO: 981 - RNA, 10 nt, Artificial Sequence
  intronic recognition element for splicing modifier (REMS)
gggaguacgg

SEQ ID NO: 982 - RNA, 10 nt, Artificial Sequence
  intronic recognition element for splicing modifier (REMS)
uggaguacgg

SEQ ID NO: 983 - RNA, 10 nt, Artificial Sequence
  intronic recognition element for splicing modifier (REMS)
  misc_feature (2)..(2): n is a, c, g, or u
ungaguacgg

SEQ ID NO: 984 - RNA, 10 nt, Artificial Sequence
  intronic recognition element for splicing modifier (REMS)
  misc_feature (1)..(1): n is a, c, g, or u
nugaguacgg

SEQ ID NO: 985 - RNA, 10 nt, Artificial Sequence
  intronic recognition element for splicing modifier (REMS)
augaguacgg

SEQ ID NO: 986 - RNA, 10 nt, Artificial Sequence
  intronic recognition element for splicing modifier (REMS)
cugaguacgg

SEQ ID NO: 987 - RNA, 10 nt, Artificial Sequence
  intronic recognition element for splicing modifier (REMS)
gugaguacgg

SEQ ID NO: 988 - RNA, 10 nt, Artificial Sequence
  intronic recognition element for splicing modifier (REMS)
uugaguacgg

SEQ ID NO: 989 - RNA, 10 nt, Artificial Sequence
  intronic recognition element for splicing modifier (REMS)
  misc_feature (2)..(2): n is a, c, g, or u
angaguaggg

SEQ ID NO: 990 - RNA, 10 nt, Artificial Sequence
  intronic recognition element for splicing modifier (REMS)
  misc_feature (1)..(1): n is a, c, g, or u
nagaguaggg

SEQ ID NO: 991 - RNA, 10 nt, Artificial Sequence
  intronic recognition element for splicing modifier (REMS)
aagaguaggg

SEQ ID NO: 992 - RNA, 10 nt, Artificial Sequence
  intronic recognition element for splicing modifier (REMS)
cagaguaggg

SEQ ID NO: 993 - RNA, 10 nt, Artificial Sequence
  intronic recognition element for splicing modifier (REMS)
gagaguaggg

SEQ ID NO: 994 - RNA, 10 nt, Artificial Sequence
  intronic recognition element for splicing modifier (REMS)
uagaguaggg

SEQ ID NO: 995 - RNA, 10 nt, Artificial Sequence
  intronic recognition element for splicing modifier (REMS)
  misc_feature (2)..(2): n is a, c, g, or u
cngaguaggg

SEQ ID NO: 996 - RNA, 10 nt, Artificial Sequence
  intronic recognition element for splicing modifier (REMS)
  misc_feature (1)..(1): n is a, c, g, or u
ncgaguaggg

SEQ ID NO: 997 - RNA, 10 nt, Artificial Sequence
  intronic recognition element for splicing modifier (REMS)
acgaguaggg

SEQ ID NO: 998 - RNA, 10 nt, Artificial Sequence
  intronic recognition element for splicing modifier (REMS)
ccgaguaggg

SEQ ID NO: 999 - RNA, 10 nt, Artificial Sequence
  intronic recognition element for splicing modifier (REMS)
gcgaguaggg

SEQ ID NO: 1000 - RNA, 10 nt, Artificial Sequence
  intronic recognition element for splicing modifier (REMS)
ucgaguaggg

SEQ ID NO: 1001 - RNA, 10 nt, Artificial Sequence
  intronic recognition element for splicing modifier (REMS)
  misc_feature (2)..(2): n is a, c, g, or u
gngaguaggg

SEQ ID NO: 1002 - RNA, 10 nt, Artificial Sequence
  intronic recognition element for splicing modifier (REMS)
  misc_feature (1)..(1): n is a, c, g, or u
nggaguaggg

SEQ ID NO: 1003 - RNA, 10 nt, Artificial Sequence
  intronic recognition element for splicing modifier (REMS)
aggaguaggg

SEQ ID NO: 1004 - RNA, 10 nt, Artificial Sequence
  intronic recognition element for splicing modifier (REMS)
cggaguaggg

SEQ ID NO: 1005 - RNA, 10 nt, Artificial Sequence
  intronic recognition element for splicing modifier (REMS)
gggaguaggg

SEQ ID NO: 1006 - RNA, 10 nt, Artificial Sequence
  intronic recognition element for splicing modifier (REMS)
uggaguaggg

SEQ ID NO: 1007 - RNA, 10 nt, Artificial Sequence
  intronic recognition element for splicing modifier (REMS)
  misc_feature (2)..(2): n is a, c, g, or u
ungaguaggg

SEQ ID NO: 1008 - RNA, 10 nt, Artificial Sequence
  intronic recognition element for splicing modifier (REMS)
  misc_feature (1)..(1): n is a, c, g, or u
nugaguaggg

SEQ ID NO: 1009 - RNA, 10 nt, Artificial Sequence
  intronic recognition element for splicing modifier (REMS)
augaguaggg

SEQ ID NO: 1010 - RNA, 10 nt, Artificial Sequence
  intronic recognition element for splicing modifier (REMS)
cugaguaggg

SEQ ID NO: 1011 - RNA, 10 nt, Artificial Sequence
  intronic recognition element for splicing modifier (REMS)
gugaguaggg

SEQ ID NO: 1012 - RNA, 10 nt, Artificial Sequence
  intronic recognition element for splicing modifier (REMS)
uugaguaggg

SEQ ID NO: 1013 - RNA, 10 nt, Artificial Sequence
  intronic recognition element for splicing modifier (REMS)
  misc_feature (2)..(2): n is a, c, g, or u
angaguaugg

SEQ ID NO: 1014 - RNA, 10 nt, Artificial Sequence
  intronic recognition element for splicing modifier (REMS)
  misc_feature (1)..(1): n is a, c, g, or u
nagaguaugg

SEQ ID NO: 1015 - RNA, 10 nt, Artificial Sequence
  intronic recognition element for splicing modifier (REMS)
aagaguaugg

SEQ ID NO: 1016 - RNA, 10 nt, Artificial Sequence
  intronic recognition element for splicing modifier (REMS)
cagaguaugg

SEQ ID NO: 1017 - RNA, 10 nt, Artificial Sequence
  intronic recognition element for splicing modifier (REMS)
gagaguaugg

SEQ ID NO: 1018 - RNA, 10 nt, Artificial Sequence
  intronic recognition element for splicing modifier (REMS)
uagaguaugg

SEQ ID NO: 1019 - RNA, 10 nt, Artificial Sequence
  intronic recognition element for splicing modifier (REMS)
  misc_feature (2)..(2): n is a, c, g, or u
cngaguaugg

SEQ ID NO: 1020 - RNA, 10 nt, Artificial Sequence
  intronic recognition element for splicing modifier (REMS)
  misc_feature (1)..(1): n is a, c, g, or u
ncgaguaugg

SEQ ID NO: 1021 - RNA, 10 nt, Artificial Sequence
  intronic recognition element for splicing modifier (REMS)
acgaguaugg

SEQ ID NO: 1022 - RNA, 10 nt, Artificial Sequence
  intronic recognition element for splicing modifier (REMS)
ccgaguaugg

SEQ ID NO: 1023 - RNA, 10 nt, Artificial Sequence
  intronic recognition element for splicing modifier (REMS)
gcgaguaugg

SEQ ID NO: 1024 - RNA, 10 nt, Artificial Sequence
  intronic recognition element for splicing modifier (REMS)
ucgaguaugg

SEQ ID NO: 1025 - RNA, 10 nt, Artificial Sequence
  intronic recognition element for splicing modifier (REMS)
  misc_feature (2)..(2): n is a, c, g, or u
gngaguaugg

SEQ ID NO: 1026 - RNA, 10 nt, Artificial Sequence
  intronic recognition element for splicing modifier (REMS)
  misc_feature (1)..(1): n is a, c, g, or u
nggaguaugg

SEQ ID NO: 1027 - RNA, 10 nt, Artificial Sequence
  intronic recognition element for splicing modifier (REMS)
aggaguaugg

SEQ ID NO: 1028 - RNA, 10 nt, Artificial Sequence
  intronic recognition element for splicing modifier (REMS)
cggaguaugg

SEQ ID NO: 1029 - RNA, 10 nt, Artificial Sequence
  intronic recognition element for splicing modifier (REMS)
gggaguaugg

SEQ ID NO: 1030 - RNA, 10 nt, Artificial Sequence
  intronic recognition element for splicing modifier (REMS)
uggaguaugg

SEQ ID NO: 1031 - RNA, 10 nt, Artificial Sequence
  intronic recognition element for splicing modifier (REMS)
  misc_feature (2)..(2): n is a, c, g, or u
ungaguaugg

SEQ ID NO: 1032 - RNA, 10 nt, Artificial Sequence
  intronic recognition element for splicing modifier (REMS)
  misc_feature (1)..(1): n is a, c, g, or u
nugaguaugg

SEQ ID NO: 1033 - RNA, 10 nt, Artificial Sequence
  intronic recognition element for splicing modifier (REMS)
augaguaugg

SEQ ID NO: 1034 - RNA, 10 nt, Artificial Sequence
  intronic recognition element for splicing modifier (REMS)
cugaguaugg

SEQ ID NO: 1035 - RNA, 10 nt, Artificial Sequence
  intronic recognition element for splicing modifier (REMS)
gugaguaugg

SEQ ID NO: 1036 - RNA, 10 nt, Artificial Sequence
  intronic recognition element for splicing modifier (REMS)
uugaguaugg

SEQ ID NO: 1037 - RNA, 10 nt, Artificial Sequence
  intronic recognition element for splicing modifier (REMS)
  misc_feature (2)..(2): n is a, c, g, or u
angaguaagu

SEQ ID NO: 1038 - RNA, 10 nt, Artificial Sequence
  intronic recognition element for splicing modifier (REMS)
  misc_feature (1)..(1): n is a, c, g, or u
nagaguaagu

SEQ ID NO: 1039 - RNA, 10 nt, Artificial Sequence
  intronic recognition element for splicing modifier (REMS)
aagaguaagu

SEQ ID NO: 1040 - RNA, 10 nt, Artificial Sequence
  intronic recognition element for splicing modifier (REMS)
cagaguaagu

SEQ ID NO: 1041 - RNA, 10 nt, Artificial Sequence
  intronic recognition element for splicing modifier (REMS)
gagaguaagu

SEQ ID NO: 1042 - RNA, 10 nt, Artificial Sequence
  intronic recognition element for splicing modifier (REMS)
uagaguaagu

SEQ ID NO: 1043 - RNA, 10 nt, Artificial Sequence
  intronic recognition element for splicing modifier (REMS)
  misc_feature (2)..(2): n is a, c, g, or u
cngaguaagu

SEQ ID NO: 1044 - RNA, 10 nt, Artificial Sequence
  intronic recognition element for splicing modifier (REMS)
  misc_feature (1)..(1): n is a, c, g, or u
ncgaguaagu

SEQ ID NO: 1045 - RNA, 10 nt, Artificial Sequence
  intronic recognition element for splicing modifier (REMS)
acgaguaagu

SEQ ID NO: 1046 - RNA, 10 nt, Artificial Sequence
  intronic recognition element for splicing modifier (REMS)
ccgaguaagu

SEQ ID NO: 1047 - RNA, 10 nt, Artificial Sequence
  intronic recognition element for splicing modifier (REMS)
gcgaguaagu

SEQ ID NO: 1048 - RNA, 10 nt, Artificial Sequence
  intronic recognition element for splicing modifier (REMS)
ucgaguaagu

SEQ ID NO: 1049 - RNA, 10 nt, Artificial Sequence
  intronic recognition element for splicing modifier (REMS)
  misc_feature (2)..(2): n is a, c, g, or u
gngaguaagu

SEQ ID NO: 1050 - RNA, 10 nt, Artificial Sequence
  intronic recognition element for splicing modifier (REMS)
  misc_feature (1)..(1): n is a, c, g, or u
nggaguaagu

SEQ ID NO: 1051 - RNA, 10 nt, Artificial Sequence
  intronic recognition element for splicing modifier (REMS)
aggaguaagu

SEQ ID NO: 1052 - RNA, 10 nt, Artificial Sequence
  intronic recognition element for splicing modifier (REMS)
cggaguaagu

SEQ ID NO: 1053 - RNA, 10 nt, Artificial Sequence
  intronic recognition element for splicing modifier (REMS)
gggaguaagu

SEQ ID NO: 1054 - RNA, 10 nt, Artificial Sequence
  intronic recognition element for splicing modifier (REMS)
uggaguaagu

SEQ ID NO: 1055 - RNA, 10 nt, Artificial Sequence
  intronic recognition element for splicing modifier (REMS)
  misc_feature (2)..(2): n is a, c, g, or u
ungaguaagu

SEQ ID NO: 1056 - RNA, 10 nt, Artificial Sequence
  intronic recognition element for splicing modifier (REMS)
  misc_feature (1)..(1): n is a, c, g, or u
nugaguaagu

SEQ ID NO: 1057 - RNA, 10 nt, Artificial Sequence
  intronic recognition element for splicing modifier (REMS)
augaguaagu

SEQ ID NO: 1058 - RNA, 10 nt, Artificial Sequence
  intronic recognition element for splicing modifier (REMS)
cugaguaagu

SEQ ID NO: 1059 - RNA, 10 nt, Artificial Sequence
  intronic recognition element for splicing modifier (REMS)
gugaguaagu

SEQ ID NO: 1060 - RNA, 10 nt, Artificial Sequence
  intronic recognition element for splicing modifier (REMS)
uugaguaagu

SEQ ID NO: 1061 - RNA, 10 nt, Artificial Sequence
  intronic recognition element for splicing modifier (REMS)
  misc_feature (2)..(2): n is a, c, g, or u
angaguacgu

SEQ ID NO: 1062 - RNA, 10 nt, Artificial Sequence
  intronic recognition element for splicing modifier (REMS)
  misc_feature (1)..(1): n is a, c, g, or u
nagaguacgu

SEQ ID NO: 1063 - RNA, 10 nt, Artificial Sequence
  intronic recognition element for splicing modifier (REMS)
aagaguacgu

SEQ ID NO: 1064 - RNA, 10 nt, Artificial Sequence
  intronic recognition element for splicing modifier (REMS)
cagaguacgu

SEQ ID NO: 1065 - RNA, 10 nt, Artificial Sequence
  intronic recognition element for splicing modifier (REMS)
gagaguacgu

SEQ ID NO: 1066 - RNA, 10 nt, Artificial Sequence
  intronic recognition element for splicing modifier (REMS)
uagaguacgu

SEQ ID NO: 1067 - RNA, 10 nt, Artificial Sequence
  intronic recognition element for splicing modifier (REMS)
  misc_feature (2)..(2): n is a, c, g, or u
cngaguacgu

SEQ ID NO: 1068 - RNA, 10 nt, Artificial Sequence
  intronic recognition element for splicing modifier (REMS)
  misc_feature (1)..(1): n is a, c, g, or u
ncgaguacgu

SEQ ID NO: 1069 - RNA, 10 nt, Artificial Sequence
  intronic recognition element for splicing modifier (REMS)
acgaguacgu

SEQ ID NO: 1070 - RNA, 10 nt, Artificial Sequence
  intronic recognition element for splicing modifier (REMS)
ccgaguacgu

SEQ ID NO: 1071 - RNA, 10 nt, Artificial Sequence
  intronic recognition element for splicing modifier (REMS)
gcgaguacgu

SEQ ID NO: 1072 - RNA, 10 nt, Artificial Sequence
  intronic recognition element for splicing modifier (REMS)
ucgaguacgu

SEQ ID NO: 1073 - RNA, 10 nt, Artificial Sequence
  intronic recognition element for splicing modifier (REMS)
  misc_feature (2)..(2): n is a, c, g, or u
gngaguacgu

SEQ ID NO: 1074 - RNA, 10 nt, Artificial Sequence
  intronic recognition element for splicing modifier (REMS)
  misc_feature (1)..(1): n is a, c, g, or u
nggaguacgu

SEQ ID NO: 1075 - RNA, 10 nt, Artificial Sequence
  intronic recognition element for splicing modifier (REMS)
aggaguacgu

SEQ ID NO: 1076 - RNA, 10 nt, Artificial Sequence
  intronic recognition element for splicing modifier (REMS)
cggaguacgu

SEQ ID NO: 1077 - RNA, 10 nt, Artificial Sequence
  intronic recognition element for splicing modifier (REMS)
gggaguacgu

SEQ ID NO: 1078 - RNA, 10 nt, Artificial Sequence
  intronic recognition element for splicing modifier (REMS)
uggaguacgu

SEQ ID NO: 1079 - RNA, 10 nt, Artificial Sequence
  intronic recognition element for splicing modifier (REMS)
  misc_feature (2)..(2): n is a, c, g, or u
ungaguacgu

SEQ ID NO: 1080 - RNA, 10 nt, Artificial Sequence
  intronic recognition element for splicing modifier (REMS)
  misc_feature (1)..(1): n is a, c, g, or u
nugaguacgu

SEQ ID NO: 1081 - RNA, 10 nt, Artificial Sequence
  intronic recognition element for splicing modifier (REMS)
augaguacgu

SEQ ID NO: 1082 - RNA, 10 nt, Artificial Sequence
  intronic recognition element for splicing modifier (REMS)
cugaguacgu

SEQ ID NO: 1083 - RNA, 10 nt, Artificial Sequence
  intronic recognition element for splicing modifier (REMS)
gugaguacgu

SEQ ID NO: 1084 - RNA, 10 nt, Artificial Sequence
  intronic recognition element for splicing modifier (REMS)
uugaguacgu

SEQ ID NO: 1085 - RNA, 10 nt, Artificial Sequence
  intronic recognition element for splicing modifier (REMS)
  misc_feature (2)..(2): n is a, c, g, or u
angaguaggu

SEQ ID NO: 1086 - RNA, 10 nt, Artificial Sequence
  intronic recognition element for splicing modifier (REMS)
  misc_feature (1)..(1): n is a, c, g, or u
nagaguaggu

SEQ ID NO: 1087 - RNA, 10 nt, Artificial Sequence
  intronic recognition element for splicing modifier (REMS)
aagaguaggu

SEQ ID NO: 1088 - RNA, 10 nt, Artificial Sequence
  intronic recognition element for splicing modifier (REMS)
cagaguaggu

SEQ ID NO: 1089 - RNA, 10 nt, Artificial Sequence
  intronic recognition element for splicing modifier (REMS)
gagaguaggu

SEQ ID NO: 1090 - RNA, 10 nt, Artificial Sequence
  intronic recognition element for splicing modifier (REMS)
uagaguaggu

SEQ ID NO: 1091 - RNA, 10 nt, Artificial Sequence
  intronic recognition element for splicing modifier (REMS)
  misc_feature (2)..(2): n is a, c, g, or u
cngaguaggu

SEQ ID NO: 1092 - RNA, 10 nt, Artificial Sequence
  intronic recognition element for splicing modifier (REMS)
  misc_feature (1)..(1): n is a, c, g, or u
ncgaguaggu

SEQ ID NO: 1093 - RNA, 10 nt, Artificial Sequence
  intronic recognition element for splicing modifier (REMS)
acgaguaggu

SEQ ID NO: 1094 - RNA, 10 nt, Artificial Sequence
  intronic recognition element for splicing modifier (REMS)
ccgaguaggu

SEQ ID NO: 1095 - RNA, 10 nt, Artificial Sequence
  intronic recognition element for splicing modifier (REMS)
gcgaguaggu

SEQ ID NO: 1096 - RNA, 10 nt, Artificial Sequence
  intronic recognition element for splicing modifier (REMS)
ucgaguaggu

SEQ ID NO: 1097 - RNA, 10 nt, Artificial Sequence
  intronic recognition element for splicing modifier (REMS)
  misc_feature (2)..(2): n is a, c, g, or u
gngaguaggu

SEQ ID NO: 1098 - RNA, 10 nt, Artificial Sequence
  intronic recognition element for splicing modifier (REMS)
  misc_feature (1)..(1): n is a, c, g, or u
nggaguaggu

SEQ ID NO: 1099 - RNA, 10 nt, Artificial Sequence
  intronic recognition element for splicing modifier (REMS)
aggaguaggu

SEQ ID NO: 1100 - RNA, 10 nt, Artificial Sequence
  intronic recognition element for splicing modifier (REMS)
cggaguaggu

SEQ ID NO: 1101 - RNA, 10 nt, Artificial Sequence
  intronic recognition element for splicing modifier (REMS)
gggaguaggu

SEQ ID NO: 1102 - RNA, 10 nt, Artificial Sequence
  intronic recognition element for splicing modifier (REMS)
uggaguaggu

SEQ ID NO: 1103 - RNA, 10 nt, Artificial Sequence
  intronic recognition element for splicing modifier (REMS)
  misc_feature (2)..(2): n is a, c, g, or u
ungaguaggu

SEQ ID NO: 1104 - RNA, 10 nt, Artificial Sequence
  intronic recognition element for splicing modifier (REMS)
  misc_feature (1)..(1): n is a, c, g, or u
nugaguaggu

SEQ ID NO: 1105 - RNA, 10 nt, Artificial Sequence
  intronic recognition element for splicing modifier (REMS)
augaguaggu

SEQ ID NO: 1106 - RNA, 10 nt, Artificial Sequence
  intronic recognition element for splicing modifier (REMS)
cugaguaggu

SEQ ID NO: 1107 - RNA, 10 nt, Artificial Sequence
  intronic recognition element for splicing modifier (REMS)
gugaguaggu

SEQ ID NO: 1108 - RNA, 10 nt, Artificial Sequence
  intronic recognition element for splicing modifier (REMS)
uugaguaggu

SEQ ID NO: 1109 - RNA, 10 nt, Artificial Sequence
  intronic recognition element for splicing modifier (REMS)
  misc_feature (2)..(2): n is a, c, g, or u
angaguaugu

SEQ ID NO: 1110 - RNA, 10 nt, Artificial Sequence
  intronic recognition element for splicing modifier (REMS)
  misc_feature (1)..(1): n is a, c, g, or u
nagaguaugu

SEQ ID NO: 1111 - RNA, 10 nt, Artificial Sequence
  intronic recognition element for splicing modifier (REMS)
aagaguaugu

SEQ ID NO: 1112 - RNA, 10 nt, Artificial Sequence
  intronic recognition element for splicing modifier (REMS)
cagaguaugu

SEQ ID NO: 1113 - RNA, 10 nt, Artificial Sequence
  intronic recognition element for splicing modifier (REMS)
gagaguaugu

SEQ ID NO: 1114 - RNA, 10 nt, Artificial Sequence
  intronic recognition element for splicing modifier (REMS)
uagaguaugu

SEQ ID NO: 1115 - RNA, 10 nt, Artificial Sequence
  intronic recognition element for splicing modifier (REMS)
  misc_feature (2)..(2): n is a, c, g, or u
cngaguaugu

SEQ ID NO: 1116 - RNA, 10 nt, Artificial Sequence
  intronic recognition element for splicing modifier (REMS)
  misc_feature (1)..(1): n is a, c, g, or u
ncgaguaugu

SEQ ID NO: 1117 - RNA, 10 nt, Artificial Sequence
  intronic recognition element for splicing modifier (REMS)
acgaguaugu

SEQ ID NO: 1118 - RNA, 10 nt, Artificial Sequence
  intronic recognition element for splicing modifier (REMS)
ccgaguaugu

SEQ ID NO: 1119 - RNA, 10 nt, Artificial Sequence
  intronic recognition element for splicing modifier (REMS)
gcgaguaugu

SEQ ID NO: 1120 - RNA, 10 nt, Artificial Sequence
  intronic recognition element for splicing modifier (REMS)
ucgaguaugu

SEQ ID NO: 1121 - RNA, 10 nt, Artificial Sequence
  intronic recognition element for splicing modifier (REMS)
  misc_feature (2)..(2): n is a, c, g, or u
gngaguaugu

SEQ ID NO: 1122 - RNA, 10 nt, Artificial Sequence
  intronic recognition element for splicing modifier (REMS)
  misc_feature (1)..(1): n is a, c, g, or u
nggaguaugu

SEQ ID NO: 1123 - RNA, 10 nt, Artificial Sequence
  intronic recognition element for splicing modifier (REMS)
aggaguaugu

SEQ ID NO: 1124 - RNA, 10 nt, Artificial Sequence
  intronic recognition element for splicing modifier (REMS)
cggaguaugu

SEQ ID NO: 1125 - RNA, 10 nt, Artificial Sequence
  intronic recognition element for splicing modifier (REMS)
gggaguaugu

SEQ ID NO: 1126 - RNA, 10 nt, Artificial Sequence
  intronic recognition element for splicing modifier (REMS)
uggaguaugu

SEQ ID NO: 1127 - RNA, 10 nt, Artificial Sequence
  intronic recognition element for splicing modifier (REMS)
  misc_feature (2)..(2): n is a, c, g, or u
ungaguaugu

SEQ ID NO: 1128 - RNA, 10 nt, Artificial Sequence
  intronic recognition element for splicing modifier (REMS)
  misc_feature (1)..(1): n is a, c, g, or u
nugaguaugu

SEQ ID NO: 1129 - RNA, 10 nt, Artificial Sequence
  intronic recognition element for splicing modifier (REMS)
augaguaugu

SEQ ID NO: 1130 - RNA, 10 nt, Artificial Sequence
  intronic recognition element for splicing modifier (REMS)
cugaguaugu

SEQ ID NO: 1131 - RNA, 10 nt, Artificial Sequence
  intronic recognition element for splicing modifier (REMS)
gugaguaugu

SEQ ID NO: 1132 - RNA, 10 nt, Artificial Sequence
  intronic recognition element for splicing modifier (REMS)
uugaguaugu

SEQ ID NO: 1133 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angaguanga

SEQ ID NO: 1134 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagaguanga

SEQ ID NO: 1135 - RNA, 10 nt, Artificial Sequence
  intronic recognition element for splicing modifier (REMS)
  misc_feature (8)..(8): n is a, c, g, or u
aagaguanga

SEQ ID NO: 1136 - RNA, 10 nt, Artificial Sequence
  intronic recognition element for splicing modifier (REMS)
  misc_feature (8)..(8): n is a, c, g, or u
cagaguanga

SEQ ID NO: 1137 - RNA, 10 nt, Artificial Sequence
  intronic recognition element for splicing modifier (REMS)
  misc_feature (8)..(8): n is a, c, g, or u
gagaguanga

SEQ ID NO: 1138 - RNA, 10 nt, Artificial Sequence
  intronic recognition element for splicing modifier (REMS)
  misc_feature (8)..(8): n is a, c, g, or u
uagaguanga

SEQ ID NO: 1139 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngaguanga

SEQ ID NO: 1140 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgaguanga

SEQ ID NO: 1141 - RNA, 10 nt, Artificial Sequence
  intronic recognition element for splicing modifier (REMS)
  misc_feature (8)..(8): n is a, c, g, or u
acgaguanga

SEQ ID NO: 1142 - RNA, 10 nt, Artificial Sequence
  intronic recognition element for splicing modifier (REMS)
  misc_feature (8)..(8): n is a, c, g, or u
ccgaguanga

SEQ ID NO: 1143 - RNA, 10 nt, Artificial Sequence
  intronic recognition element for splicing modifier (REMS)
  misc_feature (8)..(8): n is a, c, g, or u
gcgaguanga

SEQ ID NO: 1144 - RNA, 10 nt, Artificial Sequence
  intronic recognition element for splicing modifier (REMS)
  misc_feature (8)..(8): n is a, c, g, or u
ucgaguanga

SEQ ID NO: 1145 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngaguanga

SEQ ID NO: 1146 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggaguanga

SEQ ID NO: 1147 - RNA, 10 nt, Artificial Sequence
  intronic recognition element for splicing modifier (REMS)
  misc_feature (8)..(8): n is a, c, g, or u
aggaguanga

SEQ ID NO: 1148 - RNA, 10 nt, Artificial Sequence
  intronic recognition element for splicing modifier (REMS)
  misc_feature (8)..(8): n is a, c, g, or u
cggaguanga

SEQ ID NO: 1149 - RNA, 10 nt, Artificial Sequence
  intronic recognition element for splicing modifier (REMS)
  misc_feature (8)..(8): n is a, c, g, or u
gggaguanga

SEQ ID NO: 1150 - RNA, 10 nt, Artificial Sequence
  intronic recognition element for splicing modifier (REMS)
  misc_feature (8)..(8): n is a, c, g, or u
uggaguanga

SEQ ID NO: 1151 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungaguanga

SEQ ID NO: 1152 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugaguanga

SEQ ID NO: 1153 - RNA, 10 nt, Artificial Sequence
  intronic recognition element for splicing modifier (REMS)
  misc_feature (8)..(8): n is a, c, g, or u
augaguanga

SEQ ID NO: 1154 - RNA, 10 nt, Artificial Sequence
  intronic recognition element for splicing modifier (REMS)
  misc_feature (8)..(8): n is a, c, g, or u
cugaguanga

SEQ ID NO: 1155 - RNA, 10 nt, Artificial Sequence
  intronic recognition element for splicing modifier (REMS)
  misc_feature (8)..(8): n is a, c, g, or u
gugaguanga

SEQ ID NO: 1156 - RNA, 10 nt, Artificial Sequence
  intronic recognition element for splicing modifier (REMS)
  misc_feature (8)..(8): n is a, c, g, or u
uugaguanga

SEQ ID NO: 1157 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angaguangc

SEQ ID NO: 1158 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagaguangc

SEQ ID NO: 1159 - RNA, 10 nt, Artificial Sequence
  intronic recognition element for splicing modifier (REMS)
  misc_feature (8)..(8): n is a, c, g, or u
aagaguangc

SEQ ID NO: 1160 - RNA, 10 nt, Artificial Sequence
  intronic recognition element for splicing modifier (REMS)
  misc_feature (8)..(8): n is a, c, g, or u
cagaguangc

SEQ ID NO: 1161 - RNA, 10 nt, Artificial Sequence
  intronic recognition element for splicing modifier (REMS)
  misc_feature (8)..(8): n is a, c, g, or u
gagaguangc

SEQ ID NO: 1162 - RNA, 10 nt, Artificial Sequence
  intronic recognition element for splicing modifier (REMS)
  misc_feature (8)..(8): n is a, c, g, or u
uagaguangc

SEQ ID NO: 1163 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngaguangc

SEQ ID NO: 1164 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgaguangc

SEQ ID NO: 1165 - RNA, 10 nt, Artificial Sequence
  intronic recognition element for splicing modifier (REMS)
  misc_feature (8)..(8): n is a, c, g, or u
acgaguangc

SEQ ID NO: 1166 - RNA, 10 nt, Artificial Sequence
  intronic recognition element for splicing modifier (REMS)
  misc_feature (8)..(8): n is a, c, g, or u
ccgaguangc

SEQ ID NO: 1167 - RNA, 10 nt, Artificial Sequence
  intronic recognition element for splicing modifier (REMS)
  misc_feature (8)..(8): n is a, c, g, or u
gcgaguangc

SEQ ID NO: 1168 - RNA, 10 nt, Artificial Sequence
  intronic recognition element for splicing modifier (REMS)
  misc_feature (8)..(8): n is a, c, g, or u
ucgaguangc

SEQ ID NO: 1169 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngaguangc

SEQ ID NO: 1170 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggaguangc

SEQ ID NO: 1171 - RNA, 10 nt, Artificial Sequence
  intronic recognition element for splicing modifier (REMS)
  misc_feature (8)..(8): n is a, c, g, or u
aggaguangc

SEQ ID NO: 1172 - RNA, 10 nt, Artificial Sequence
  intronic recognition element for splicing modifier (REMS)
  misc_feature (8)..(8): n is a, c, g, or u
cggaguangc

SEQ ID NO: 1173 - RNA, 10 nt, Artificial Sequence
  intronic recognition element for splicing modifier (REMS)
  misc_feature (8)..(8): n is a, c, g, or u
gggaguangc

SEQ ID NO: 1174 - RNA, 10 nt, Artificial Sequence
  intronic recognition element for splicing modifier (REMS)
  misc_feature (8)..(8): n is a, c, g, or u
uggaguangc

SEQ ID NO: 1175 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungaguangc

SEQ ID NO: 1176 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugaguangc

SEQ ID NO: 1177 - RNA, 10 nt, Artificial Sequence
  intronic recognition element for splicing modifier (REMS)
  misc_feature (8)..(8): n is a, c, g, or u
augaguangc

SEQ ID NO: 1178 - RNA, 10 nt, Artificial Sequence
  intronic recognition element for splicing modifier (REMS)
  misc_feature (8)..(8): n is a, c, g, or u
cugaguangc

SEQ ID NO: 1179 - RNA, 10 nt, Artificial Sequence
  intronic recognition element for splicing modifier (REMS)
  misc_feature (8)..(8): n is a, c, g, or u
gugaguangc

SEQ ID NO: 1180 - RNA, 10 nt, Artificial Sequence
  intronic recognition element for splicing modifier (REMS)
  misc_feature (8)..(8): n is a, c, g, or u
uugaguangc

SEQ ID NO: 1181 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angaguangg

SEQ ID NO: 1182 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagaguangg

SEQ ID NO: 1183 - RNA, 10 nt, Artificial Sequence
  intronic recognition element for splicing modifier (REMS)
  misc_feature (8)..(8): n is a, c, g, or u
aagaguangg

SEQ ID NO: 1184 - RNA, 10 nt, Artificial Sequence
  intronic recognition element for splicing modifier (REMS)
  misc_feature (8)..(8): n is a, c, g, or u
cagaguangg

SEQ ID NO: 1185 - RNA, 10 nt, Artificial Sequence
  intronic recognition element for splicing modifier (REMS)
  misc_feature (8)..(8): n is a, c, g, or u
gagaguangg

SEQ ID NO: 1186 - RNA, 10 nt, Artificial Sequence
  intronic recognition element for splicing modifier (REMS)
  misc_feature (8)..(8): n is a, c, g, or u
uagaguangg

SEQ ID NO: 1187 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngaguangg

SEQ ID NO: 1188 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgaguangg

SEQ ID NO: 1189 - RNA, 10 nt, Artificial Sequence
  intronic recognition element for splicing modifier (REMS)
  misc_feature (8)..(8): n is a, c, g, or u
acgaguangg

SEQ ID NO: 1190 - RNA, 10 nt, Artificial Sequence
  intronic recognition element for splicing modifier (REMS)
  misc_feature (8)..(8): n is a, c, g, or u
ccgaguangg

SEQ ID NO: 1191 - RNA, 10 nt, Artificial Sequence
  intronic recognition element for splicing modifier (REMS)
  misc_feature (8)..(8): n is a, c, g, or u
gcgaguangg

SEQ ID NO: 1192 - RNA, 10 nt, Artificial Sequence
  intronic recognition element for splicing modifier (REMS)
  misc_feature (8)..(8): n is a, c, g, or u
ucgaguangg

SEQ ID NO: 1193 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngaguangg

SEQ ID NO: 1194 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggaguangg

SEQ ID NO: 1195 - RNA, 10 nt, Artificial Sequence
  intronic recognition element for splicing modifier (REMS)
  misc_feature (8)..(8): n is a, c, g, or u
aggaguangg

SEQ ID NO: 1196 - RNA, 10 nt, Artificial Sequence
  intronic recognition element for splicing modifier (REMS)
  misc_feature (8)..(8): n is a, c, g, or u
cggaguangg

SEQ ID NO: 1197 - RNA, 10 nt, Artificial Sequence
  intronic recognition element for splicing modifier (REMS)
  misc_feature (8)..(8): n is a, c, g, or u
gggaguangg

SEQ ID NO: 1198 - RNA, 10 nt, Artificial Sequence
  intronic recognition element for splicing modifier (REMS)
  misc_feature (8)..(8): n is a, c, g, or u
uggaguangg

SEQ ID NO: 1199 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungaguangg

SEQ ID NO: 1200 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugaguangg

SEQ ID NO: 1201 - RNA, 10 nt, Artificial Sequence
  intronic recognition element for splicing modifier (REMS)
  misc_feature (8)..(8): n is a, c, g, or u
augaguangg

SEQ ID NO: 1202 - RNA, 10 nt, Artificial Sequence
  intronic recognition element for splicing modifier (REMS)
  misc_feature (8)..(8): n is a, c, g, or u
cugaguangg

SEQ ID NO: 1203 - RNA, 10 nt, Artificial Sequence
  intronic recognition element for splicing modifier (REMS)
  misc_feature (8)..(8): n is a, c, g, or u
gugaguangg

SEQ ID NO: 1204 - RNA, 10 nt, Artificial Sequence
  intronic recognition element for splicing modifier (REMS)
  misc_feature (8)..(8): n is a, c, g, or u
uugaguangg

SEQ ID NO: 1205 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angaguangu

SEQ ID NO: 1206 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagaguangu

SEQ ID NO: 1207 - RNA, 10 nt, Artificial Sequence
  intronic recognition element for splicing modifier (REMS)
  misc_feature (8)..(8): n is a, c, g, or u
aagaguangu

SEQ ID NO: 1208 - RNA, 10 nt, Artificial Sequence
  intronic recognition element for splicing modifier (REMS)
  misc_feature (8)..(8): n is a, c, g, or u
cagaguangu

SEQ ID NO: 1209 - RNA, 10 nt, Artificial Sequence
  intronic recognition element for splicing modifier (REMS)
  misc_feature (8)..(8): n is a, c, g, or u
gagaguangu

SEQ ID NO: 1210 - RNA, 10 nt, Artificial Sequence
  intronic recognition element for splicing modifier (REMS)
  misc_feature (8)..(8): n is a, c, g, or u
uagaguangu

SEQ ID NO: 1211 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngaguangu

SEQ ID NO: 1212 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgaguangu

SEQ ID NO: 1213 - RNA, 10 nt, Artificial Sequence
  intronic recognition element for splicing modifier (REMS)
  misc_feature (8)..(8): n is a, c, g, or u
acgaguangu

SEQ ID NO: 1214 - RNA, 10 nt, Artificial Sequence
  intronic recognition element for splicing modifier (REMS)
  misc_feature (8)..(8): n is a, c, g, or u
ccgaguangu

SEQ ID NO: 1215 - RNA, 10 nt, Artificial Sequence
  intronic recognition element for splicing modifier (REMS)
  misc_feature (8)..(8): n is a, c, g, or u
gcgaguangu

SEQ ID NO: 1216 - RNA, 10 nt, Artificial Sequence
  intronic recognition element for splicing modifier (REMS)
  misc_feature (8)..(8): n is a, c, g, or u
ucgaguangu

SEQ ID NO: 1217 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngaguangu

SEQ ID NO: 1218 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggaguangu

SEQ ID NO: 1219 - RNA, 10 nt, Artificial Sequence
  intronic recognition element for splicing modifier (REMS)
  misc_feature (8)..(8): n is a, c, g, or u
aggaguangu

SEQ ID NO: 1220 - RNA, 10 nt, Artificial Sequence
  intronic recognition element for splicing modifier (REMS)
  misc_feature (8)..(8): n is a, c, g, or u
cggaguangu

SEQ ID NO: 1221 - RNA, 10 nt, Artificial Sequence
  intronic recognition element for splicing modifier (REMS)
  misc_feature (8)..(8): n is a, c, g, or u
gggaguangu

SEQ ID NO: 1222 - RNA, 10 nt, Artificial Sequence
  intronic recognition element for splicing modifier (REMS)
  misc_feature (8)..(8): n is a, c, g, or u
uggaguangu

SEQ ID NO: 1223 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungaguangu

SEQ ID NO: 1224 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugaguangu

SEQ ID NO: 1225 - RNA, 10 nt, Artificial Sequence
  intronic recognition element for splicing modifier (REMS)
  misc_feature (8)..(8): n is a, c, g, or u
augaguangu

SEQ ID NO: 1226 - RNA, 10 nt, Artificial Sequence
  intronic recognition element for splicing modifier (REMS)
  misc_feature (8)..(8): n is a, c, g, or u
cugaguangu

SEQ ID NO: 1227 - RNA, 10 nt, Artificial Sequence
  intronic recognition element for splicing modifier (REMS)
  misc_feature (8)..(8): n is a, c, g, or u
gugaguangu

SEQ ID NO: 1228 - RNA, 10 nt, Artificial Sequence
  intronic recognition element for splicing modifier (REMS)
  misc_feature (8)..(8): n is a, c, g, or u
uugaguangu

SEQ ID NO: 1229 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
angagugngn

SEQ ID NO: 1230 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nagagugngn

SEQ ID NO: 1231 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
aagagugngn

SEQ ID NO: 1232 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cagagugngn

SEQ ID NO: 1233 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gagagugngn

SEQ ID NO: 1234 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uagagugngn

SEQ ID NO: 1235 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
cngagugngn

SEQ ID NO: 1236 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
ncgagugngn

SEQ ID NO: 1237 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
acgagugngn

SEQ ID NO: 1238 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
ccgagugngn

SEQ ID NO: 1239 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gcgagugngn

SEQ ID NO: 1240 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
ucgagugngn

SEQ ID NO: 1241 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
gngagugngn

SEQ ID NO: 1242 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nggagugngn

SEQ ID NO: 1243 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
aggagugngn

SEQ ID NO: 1244 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cggagugngn

SEQ ID NO: 1245 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gggagugngn

SEQ ID NO: 1246 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uggagugngn

SEQ ID NO: 1247 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
  misc_feature (10)..(10): n is a, c, g, or u
ungagugngn

SEQ ID NO: 1248 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
  misc_feature (10)..(10): n is a, c, g, or u
nugagugngn

SEQ ID NO: 1249 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
augagugngn

SEQ ID NO: 1250 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
cugagugngn

SEQ ID NO: 1251 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
gugagugngn

SEQ ID NO: 1252 - RNA, 10 nt, Artificial Sequence
  intronic recognition element for splicing modifier (REMS)
  misc_feature (8)..(8): n is a, c, g, or u
  misc_feature (10)..(10): n is a, c, g, or u
uugagugngn

SEQ ID NO: 1253 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angagugagn

SEQ ID NO: 1254 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagagugagn

SEQ ID NO: 1255 - RNA, 10 nt, Artificial Sequence
  intronic recognition element for splicing modifier (REMS)
  misc_feature (10)..(10): n is a, c, g, or u
aagagugagn

SEQ ID NO: 1256 - RNA, 10 nt, Artificial Sequence
  intronic recognition element for splicing modifier (REMS)
  misc_feature (10)..(10): n is a, c, g, or u
cagagugagn

SEQ ID NO: 1257 - RNA, 10 nt, Artificial Sequence
  intronic recognition element for splicing modifier (REMS)
  misc_feature (10)..(10): n is a, c, g, or u
gagagugagn

SEQ ID NO: 1258 - RNA, 10 nt, Artificial Sequence
  intronic recognition element for splicing modifier (REMS)
  misc_feature (10)..(10): n is a, c, g, or u
uagagugagn

SEQ ID NO: 1259 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngagugagn

SEQ ID NO: 1260 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgagugagn

SEQ ID NO: 1261 - RNA, 10 nt, Artificial Sequence
  intronic recognition element for splicing modifier (REMS)
  misc_feature (10)..(10): n is a, c, g, or u
acgagugagn

SEQ ID NO: 1262 - RNA, 10 nt, Artificial Sequence
  intronic recognition element for splicing modifier (REMS)
  misc_feature (10)..(10): n is a, c, g, or u
ccgagugagn

SEQ ID NO: 1263 - RNA, 10 nt, Artificial Sequence
  intronic recognition element for splicing modifier (REMS)
  misc_feature (10)..(10): n is a, c, g, or u
gcgagugagn

SEQ ID NO: 1264 - RNA, 10 nt, Artificial Sequence
  intronic recognition element for splicing modifier (REMS)
  misc_feature (10)..(10): n is a, c, g, or u
ucgagugagn

SEQ ID NO: 1265 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngagugagn

SEQ ID NO: 1266 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggagugagn

SEQ ID NO: 1267 - RNA, 10 nt, Artificial Sequence
  intronic recognition element for splicing modifier (REMS)
  misc_feature (10)..(10): n is a, c, g, or u
aggagugagn

SEQ ID NO: 1268 - RNA, 10 nt, Artificial Sequence
  intronic recognition element for splicing modifier (REMS)
  misc_feature (10)..(10): n is a, c, g, or u
cggagugagn

SEQ ID NO: 1269 - RNA, 10 nt, Artificial Sequence
  intronic recognition element for splicing modifier (REMS)
  misc_feature (10)..(10): n is a, c, g, or u
gggagugagn

SEQ ID NO: 1270 - RNA, 10 nt, Artificial Sequence
  intronic recognition element for splicing modifier (REMS)
  misc_feature (10)..(10): n is a, c, g, or u
uggagugagn

SEQ ID NO: 1271 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungagugagn

SEQ ID NO: 1272 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugagugagn

SEQ ID NO: 1273 - RNA, 10 nt, Artificial Sequence
  intronic recognition element for splicing modifier (REMS)
  misc_feature (10)..(10): n is a, c, g, or u
augagugagn

SEQ ID NO: 1274 - RNA, 10 nt, Artificial Sequence
  intronic recognition element for splicing modifier (REMS)
  misc_feature (10)..(10): n is a, c, g, or u
cugagugagn

SEQ ID NO: 1275 - RNA, 10 nt, Artificial Sequence
  intronic recognition element for splicing modifier (REMS)
  misc_feature (10)..(10): n is a, c, g, or u
gugagugagn

SEQ ID NO: 1276 - RNA, 10 nt, Artificial Sequence
  intronic recognition element for splicing modifier (REMS)
  misc_feature (10)..(10): n is a, c, g, or u
uugagugagn

SEQ ID NO: 1277 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angagugcgn

SEQ ID NO: 1278 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagagugcgn

SEQ ID NO: 1279 - RNA, 10 nt, Artificial Sequence
  intronic recognition element for splicing modifier (REMS)
  misc_feature (10)..(10): n is a, c, g, or u
aagagugcgn

SEQ ID NO: 1280 - RNA, 10 nt, Artificial Sequence
  intronic recognition element for splicing modifier (REMS)
  misc_feature (10)..(10): n is a, c, g, or u
cagagugcgn

SEQ ID NO: 1281 - RNA, 10 nt, Artificial Sequence
  intronic recognition element for splicing modifier (REMS)
  misc_feature (10)..(10): n is a, c, g, or u
gagagugcgn

SEQ ID NO: 1282 - RNA, 10 nt, Artificial Sequence
  intronic recognition element for splicing modifier (REMS)
  misc_feature (10)..(10): n is a, c, g, or u
uagagugcgn

SEQ ID NO: 1283 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngagugcgn

SEQ ID NO: 1284 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgagugcgn

SEQ ID NO: 1285 - RNA, 10 nt, Artificial Sequence
  intronic recognition element for splicing modifier (REMS)
  misc_feature (10)..(10): n is a, c, g, or u
acgagugcgn

SEQ ID NO: 1286 - RNA, 10 nt, Artificial Sequence
  intronic recognition element for splicing modifier (REMS)
  misc_feature (10)..(10): n is a, c, g, or u
ccgagugcgn

SEQ ID NO: 1287 - RNA, 10 nt, Artificial Sequence
  intronic recognition element for splicing modifier (REMS)
  misc_feature (10)..(10): n is a, c, g, or u
gcgagugcgn

SEQ ID NO: 1288 - RNA, 10 nt, Artificial Sequence
  intronic recognition element for splicing modifier (REMS)
  misc_feature (10)..(10): n is a, c, g, or u
ucgagugcgn

SEQ ID NO: 1289 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngagugcgn

SEQ ID NO: 1290 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggagugcgn

SEQ ID NO: 1291 - RNA, 10 nt, Artificial Sequence
  intronic recognition element for splicing modifier (REMS)
  misc_feature (10)..(10): n is a, c, g, or u
aggagugcgn

SEQ ID NO: 1292 - RNA, 10 nt, Artificial Sequence
  intronic recognition element for splicing modifier (REMS)
  misc_feature (10)..(10): n is a, c, g, or u
cggagugcgn

SEQ ID NO: 1293 - RNA, 10 nt, Artificial Sequence
  intronic recognition element for splicing modifier (REMS)
  misc_feature (10)..(10): n is a, c, g, or u
gggagugcgn

SEQ ID NO: 1294 - RNA, 10 nt, Artificial Sequence
  intronic recognition element for splicing modifier (REMS)
  misc_feature (10)..(10): n is a, c, g, or u
uggagugcgn

SEQ ID NO: 1295 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungagugcgn

SEQ ID NO: 1296 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugagugcgn

SEQ ID NO: 1297 - RNA, 10 nt, Artificial Sequence
  intronic recognition element for splicing modifier (REMS)
  misc_feature (10)..(10): n is a, c, g, or u
augagugcgn

SEQ ID NO: 1298 - RNA, 10 nt, Artificial Sequence
  intronic recognition element for splicing modifier (REMS)
  misc_feature (10)..(10): n is a, c, g, or u
cugagugcgn

SEQ ID NO: 1299 - RNA, 10 nt, Artificial Sequence
  intronic recognition element for splicing modifier (REMS)
  misc_feature (10)..(10): n is a, c, g, or u
gugagugcgn

SEQ ID NO: 1300 - RNA, 10 nt, Artificial Sequence
  intronic recognition element for splicing modifier (REMS)
  misc_feature (10)..(10): n is a, c, g, or u
uugagugcgn

SEQ ID NO: 1301 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angagugggn

SEQ ID NO: 1302 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagagugggn

SEQ ID NO: 1303 - RNA, 10 nt, Artificial Sequence
  intronic recognition element for splicing modifier (REMS)
  misc_feature (10)..(10): n is a, c, g, or u
aagagugggn

SEQ ID NO: 1304 - RNA, 10 nt, Artificial Sequence
  intronic recognition element for splicing modifier (REMS)
  misc_feature (10)..(10): n is a, c, g, or u
cagagugggn

SEQ ID NO: 1305 - RNA, 10 nt, Artificial Sequence
  intronic recognition element for splicing modifier (REMS)
  misc_feature (10)..(10): n is a, c, g, or u
gagagugggn

SEQ ID NO: 1306 - RNA, 10 nt, Artificial Sequence
  intronic recognition element for splicing modifier (REMS)
  misc_feature (10)..(10): n is a, c, g, or u
uagagugggn

SEQ ID NO: 1307 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngagugggn

SEQ ID NO: 1308 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgagugggn

SEQ ID NO: 1309 - RNA, 10 nt, Artificial Sequence
  intronic recognition element for splicing modifier (REMS)
  misc_feature (10)..(10): n is a, c, g, or u
acgagugggn

SEQ ID NO: 1310 - RNA, 10 nt, Artificial Sequence
  intronic recognition element for splicing modifier (REMS)
  misc_feature (10)..(10): n is a, c, g, or u
ccgagugggn

SEQ ID NO: 1311 - RNA, 10 nt, Artificial Sequence
  intronic recognition element for splicing modifier (REMS)
  misc_feature (10)..(10): n is a, c, g, or u
gcgagugggn

SEQ ID NO: 1312 - RNA, 10 nt, Artificial Sequence
  intronic recognition element for splicing modifier (REMS)
  misc_feature (10)..(10): n is a, c, g, or u
ucgagugggn

SEQ ID NO: 1313 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngagugggn

SEQ ID NO: 1314 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggagugggn

SEQ ID NO: 1315 - RNA, 10 nt, Artificial Sequence
  intronic recognition element for splicing modifier (REMS)
  misc_feature (10)..(10): n is a, c, g, or u
aggagugggn

SEQ ID NO: 1316 - RNA, 10 nt, Artificial Sequence
  intronic recognition element for splicing modifier (REMS)
  misc_feature (10)..(10): n is a, c, g, or u
cggagugggn

SEQ ID NO: 1317 - RNA, 10 nt, Artificial Sequence
  intronic recognition element for splicing modifier (REMS)
  misc_feature (10)..(10): n is a, c, g, or u
gggagugggn

SEQ ID NO: 1318 - RNA, 10 nt, Artificial Sequence
  intronic recognition element for splicing modifier (REMS)
  misc_feature (10)..(10): n is a, c, g, or u
uggagugggn

SEQ ID NO: 1319 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungagugggn

SEQ ID NO: 1320 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugagugggn

SEQ ID NO: 1321 - RNA, 10 nt, Artificial Sequence
  intronic recognition element for splicing modifier (REMS)
  misc_feature (10)..(10): n is a, c, g, or u
augagugggn

SEQ ID NO: 1322 - RNA, 10 nt, Artificial Sequence
  intronic recognition element for splicing modifier (REMS)
  misc_feature (10)..(10): n is a, c, g, or u
cugagugggn

SEQ ID NO: 1323 - RNA, 10 nt, Artificial Sequence
  intronic recognition element for splicing modifier (REMS)
  misc_feature (10)..(10): n is a, c, g, or u
gugagugggn

SEQ ID NO: 1324 - RNA, 10 nt, Artificial Sequence
  intronic recognition element for splicing modifier (REMS)
  misc_feature (10)..(10): n is a, c, g, or u
uugagugggn

SEQ ID NO: 1325 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
angagugugn

SEQ ID NO: 1326 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nagagugugn

SEQ ID NO: 1327 - RNA, 10 nt, Artificial Sequence
  intronic recognition element for splicing modifier (REMS)
  misc_feature (10)..(10): n is a, c, g, or u
aagagugugn

SEQ ID NO: 1328 - RNA, 10 nt, Artificial Sequence
  intronic recognition element for splicing modifier (REMS)
  misc_feature (10)..(10): n is a, c, g, or u
cagagugugn

SEQ ID NO: 1329 - RNA, 10 nt, Artificial Sequence
  intronic recognition element for splicing modifier (REMS)
  misc_feature (10)..(10): n is a, c, g, or u
gagagugugn

SEQ ID NO: 1330 - RNA, 10 nt, Artificial Sequence
  intronic recognition element for splicing modifier (REMS)
  misc_feature (10)..(10): n is a, c, g, or u
uagagugugn

SEQ ID NO: 1331 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
cngagugugn

SEQ ID NO: 1332 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
ncgagugugn

SEQ ID NO: 1333 - RNA, 10 nt, Artificial Sequence
  intronic recognition element for splicing modifier (REMS)
  misc_feature (10)..(10): n is a, c, g, or u
acgagugugn

SEQ ID NO: 1334 - RNA, 10 nt, Artificial Sequence
  intronic recognition element for splicing modifier (REMS)
  misc_feature (10)..(10): n is a, c, g, or u
ccgagugugn

SEQ ID NO: 1335 - RNA, 10 nt, Artificial Sequence
  intronic recognition element for splicing modifier (REMS)
  misc_feature (10)..(10): n is a, c, g, or u
gcgagugugn

SEQ ID NO: 1336 - RNA, 10 nt, Artificial Sequence
  intronic recognition element for splicing modifier (REMS)
  misc_feature (10)..(10): n is a, c, g, or u
ucgagugugn

SEQ ID NO: 1337 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
gngagugugn

SEQ ID NO: 1338 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nggagugugn

SEQ ID NO: 1339 - RNA, 10 nt, Artificial Sequence
  intronic recognition element for splicing modifier (REMS)
  misc_feature (10)..(10): n is a, c, g, or u
aggagugugn

SEQ ID NO: 1340 - RNA, 10 nt, Artificial Sequence
  intronic recognition element for splicing modifier (REMS)
  misc_feature (10)..(10): n is a, c, g, or u
cggagugugn

SEQ ID NO: 1341 - RNA, 10 nt, Artificial Sequence
  intronic recognition element for splicing modifier (REMS)
  misc_feature (10)..(10): n is a, c, g, or u
gggagugugn

SEQ ID NO: 1342 - RNA, 10 nt, Artificial Sequence
  intronic recognition element for splicing modifier (REMS)
  misc_feature (10)..(10): n is a, c, g, or u
uggagugugn

SEQ ID NO: 1343 - RNA, 10 nt, Artificial Sequence
  intronic recognition element for splicing modifier (REMS)
  misc_feature (2)..(2): n is a, c, g, or u
  misc_feature (10)..(10): n is a, c, g, or u
ungagugugn

SEQ ID NO: 1344 - RNA, 10 nt, Artificial Sequence
  intronic recognition element for splicing modifier (REMS)
  misc_feature (1)..(1): n is a, c, g, or u
  misc_feature (10)..(10): n is a, c, g, or u
nugagugugn

SEQ ID NO: 1345 - RNA, 10 nt, Artificial Sequence
  intronic recognition element for splicing modifier (REMS)
  misc_feature (10)..(10): n is a, c, g, or u
augagugugn

SEQ ID NO: 1346 - RNA, 10 nt, Artificial Sequence
  intronic recognition element for splicing modifier (REMS)
  misc_feature (10)..(10): n is a, c, g, or u
cugagugugn

SEQ ID NO: 1347 - RNA, 10 nt, Artificial Sequence
  intronic recognition element for splicing modifier (REMS)
  misc_feature (10)..(10): n is a, c, g, or u
gugagugugn

SEQ ID NO: 1348 - RNA, 10 nt, Artificial Sequence
  intronic recognition element for splicing modifier (REMS)
  misc_feature (10)..(10): n is a, c, g, or u
uugagugugn

SEQ ID NO: 1349 - RNA, 10 nt, Artificial Sequence
  intronic recognition element for splicing modifier (REMS)
  misc_feature (2)..(2): n is a, c, g, or u
angagugaga

SEQ ID NO: 1350 - RNA, 10 nt, Artificial Sequence
  intronic recognition element for splicing modifier (REMS)
  misc_feature (1)..(1): n is a, c, g, or u
nagagugaga

SEQ ID NO: 1351 - RNA, 10 nt, Artificial Sequence
  intronic recognition element for splicing modifier (REMS)
aagagugaga

SEQ ID NO: 1352 - RNA, 10 nt, Artificial Sequence
  intronic recognition element for splicing modifier (REMS)
cagagugaga

SEQ ID NO: 1353 - RNA, 10 nt, Artificial Sequence
  intronic recognition element for splicing modifier (REMS)
gagagugaga

SEQ ID NO: 1354 - RNA, 10 nt, Artificial Sequence
  intronic recognition element for splicing modifier (REMS)
uagagugaga

SEQ ID NO: 1355 - RNA, 10 nt, Artificial Sequence
  intronic recognition element for splicing modifier (REMS)
  misc_feature (2)..(2): n is a, c, g, or u
cngagugaga

SEQ ID NO: 1356 - RNA, 10 nt, Artificial Sequence
  intronic recognition element for splicing modifier (REMS)
  misc_feature (1)..(1): n is a, c, g, or u
ncgagugaga

SEQ ID NO: 1357 - RNA, 10 nt, Artificial Sequence
  intronic recognition element for splicing modifier (REMS)
acgagugaga

SEQ ID NO: 1358 - RNA, 10 nt, Artificial Sequence
  intronic recognition element for splicing modifier (REMS)
ccgagugaga

SEQ ID NO: 1359 - RNA, 10 nt, Artificial Sequence
  intronic recognition element for splicing modifier (REMS)
gcgagugaga

SEQ ID NO: 1360 - RNA, 10 nt, Artificial Sequence
  intronic recognition element for splicing modifier (REMS)
ucgagugaga

SEQ ID NO: 1361 - RNA, 10 nt, Artificial Sequence
  intronic recognition element for splicing modifier (REMS)
  misc_feature (2)..(2): n is a, c, g, or u
gngagugaga

SEQ ID NO: 1362 - RNA, 10 nt, Artificial Sequence
  intronic recognition element for splicing modifier (REMS)
  misc_feature (1)..(1): n is a, c, g, or u
nggagugaga

SEQ ID NO: 1363 - RNA, 10 nt, Artificial Sequence
  intronic recognition element for splicing modifier (REMS)
aggagugaga

SEQ ID NO: 1364 - RNA, 10 nt, Artificial Sequence
  intronic recognition element for splicing modifier (REMS)
cggagugaga

SEQ ID NO: 1365 - RNA, 10 nt, Artificial Sequence
  intronic recognition element for splicing modifier (REMS)
gggagugaga

SEQ ID NO: 1366 - RNA, 10 nt, Artificial Sequence
  intronic recognition element for splicing modifier (REMS)
uggagugaga

SEQ ID NO: 1367 - RNA, 10 nt, Artificial Sequence
  intronic recognition element for splicing modifier (REMS)
  misc_feature (2)..(2): n is a, c, g, or u
ungagugaga

SEQ ID NO: 1368 - RNA, 10 nt, Artificial Sequence
  intronic recognition element for splicing modifier (REMS)
  misc_feature (1)..(1): n is a, c, g, or u
nugagugaga

SEQ ID NO: 1369 - RNA, 10 nt, Artificial Sequence
  intronic recognition element for splicing modifier (REMS)
augagugaga

SEQ ID NO: 1370 - RNA, 10 nt, Artificial Sequence
  intronic recognition element for splicing modifier (REMS)
cugagugaga

SEQ ID NO: 1371 - RNA, 10 nt, Artificial Sequence
  intronic recognition element for splicing modifier (REMS)
gugagugaga

SEQ ID NO: 1372 - RNA, 10 nt, Artificial Sequence
  intronic recognition element for splicing modifier (REMS)
uugagugaga

SEQ ID NO: 1373 - RNA, 10 nt, Artificial Sequence
  intronic recognition element for splicing modifier (REMS)
  misc_feature (2)..(2): n is a, c, g, or u
angagugcga

SEQ ID NO: 1374 - RNA, 10 nt, Artificial Sequence
  intronic recognition element for splicing modifier (REMS)
  misc_feature (1)..(1): n is a, c, g, or u
nagagugcga

SEQ ID NO: 1375 - RNA, 10 nt, Artificial Sequence
  intronic recognition element for splicing modifier (REMS)
aagagugcga

SEQ ID NO: 1376 - RNA, 10 nt, Artificial Sequence
  intronic recognition element for splicing modifier (REMS)
cagagugcga

SEQ ID NO: 1377 - RNA, 10 nt, Artificial Sequence
  intronic recognition element for splicing modifier (REMS)
gagagugcga

SEQ ID NO: 1378 - RNA, 10 nt, Artificial Sequence
  intronic recognition element for splicing modifier (REMS)
uagagugcga

SEQ ID NO: 1379 - RNA, 10 nt, Artificial Sequence
  intronic recognition element for splicing modifier (REMS)
  misc_feature (2)..(2): n is a, c, g, or u
cngagugcga

SEQ ID NO: 1380 - RNA, 10 nt, Artificial Sequence
  intronic recognition element for splicing modifier (REMS)
  misc_feature (1)..(1): n is a, c, g, or u
ncgagugcga

SEQ ID NO: 1381 - RNA, 10 nt, Artificial Sequence
  intronic recognition element for splicing modifier (REMS)
acgagugcga

SEQ ID NO: 1382 - RNA, 10 nt, Artificial Sequence
  intronic recognition element for splicing modifier (REMS)
ccgagugcga

SEQ ID NO: 1383 - RNA, 10 nt, Artificial Sequence
  intronic recognition element for splicing modifier (REMS)
gcgagugcga

SEQ ID NO: 1384 - RNA, 10 nt, Artificial Sequence
  intronic recognition element for splicing modifier (REMS)
ucgagugcga

SEQ ID NO: 1385 - RNA, 10 nt, Artificial Sequence
  intronic recognition element for splicing modifier (REMS)
  misc_feature (2)..(2): n is a, c, g, or u
gngagugcga

SEQ ID NO: 1386 - RNA, 10 nt, Artificial Sequence
  intronic recognition element for splicing modifier (REMS)
  misc_feature (1)..(1): n is a, c, g, or u
nggagugcga

SEQ ID NO: 1387 - RNA, 10 nt, Artificial Sequence
  intronic recognition element for splicing modifier (REMS)
aggagugcga

SEQ ID NO: 1388 - RNA, 10 nt, Artificial Sequence
  intronic recognition element for splicing modifier (REMS)
cggagugcga

SEQ ID NO: 1389 - RNA, 10 nt, Artificial Sequence
  intronic recognition element for splicing modifier (REMS)
gggagugcga

SEQ ID NO: 1390 - RNA, 10 nt, Artificial Sequence
  intronic recognition element for splicing modifier (REMS)
uggagugcga

SEQ ID NO: 1391 - RNA, 10 nt, Artificial Sequence
  intronic recognition element for splicing modifier (REMS)
  misc_feature (2)..(2): n is a, c, g, or u
ungagugcga

SEQ ID NO: 1392 - RNA, 10 nt, Artificial Sequence
  intronic recognition element for splicing modifier (REMS)
  misc_feature (1)..(1): n is a, c, g, or u
nugagugcga

SEQ ID NO: 1393 - RNA, 10 nt, Artificial Sequence
  intronic recognition element for splicing modifier (REMS)
augagugcga

SEQ ID NO: 1394 - RNA, 10 nt, Artificial Sequence
  intronic recognition element for splicing modifier (REMS)
cugagugcga

SEQ ID NO: 1395 - RNA, 10 nt, Artificial Sequence
  intronic recognition element for splicing modifier (REMS)
gugagugcga

SEQ ID NO: 1396 - RNA, 10 nt, Artificial Sequence
  intronic recognition element for splicing modifier (REMS)
uugagugcga

SEQ ID NO: 1397 - RNA, 10 nt, Artificial Sequence
  intronic recognition element for splicing modifier (REMS)
  misc_feature (2)..(2): n is a, c, g, or u
angaguggga

SEQ ID NO: 1398 - RNA, 10 nt, Artificial Sequence
  intronic recognition element for splicing modifier (REMS)
  misc_feature (1)..(1): n is a, c, g, or u
nagaguggga

SEQ ID NO: 1399 - RNA, 10 nt, Artificial Sequence
  intronic recognition element for splicing modifier (REMS)
aagaguggga

SEQ ID NO: 1400 - RNA, 10 nt, Artificial Sequence
  intronic recognition element for splicing modifier (REMS)
cagaguggga

SEQ ID NO: 1401 - RNA, 10 nt, Artificial Sequence
  intronic recognition element for splicing modifier (REMS)
gagaguggga

SEQ ID NO: 1402 - RNA, 10 nt, Artificial Sequence
  intronic recognition element for splicing modifier (REMS)
uagaguggga

SEQ ID NO: 1403 - RNA, 10 nt, Artificial Sequence
  intronic recognition element for splicing modifier (REMS)
  misc_feature (2)..(2): n is a, c, g, or u
cngaguggga

SEQ ID NO: 1404 - RNA, 10 nt, Artificial Sequence
  intronic recognition element for splicing modifier (REMS)
  misc_feature (1)..(1): n is a, c, g, or u
ncgaguggga

SEQ ID NO: 1405 - RNA, 10 nt, Artificial Sequence
  intronic recognition element for splicing modifier (REMS)
acgaguggga

SEQ ID NO: 1406 - RNA, 10 nt, Artificial Sequence
  intronic recognition element for splicing modifier (REMS)
ccgaguggga

SEQ ID NO: 1407 - RNA, 10 nt, Artificial Sequence
  intronic recognition element for splicing modifier (REMS)
gcgaguggga

SEQ ID NO: 1408 - RNA, 10 nt, Artificial Sequence
  intronic recognition element for splicing modifier (REMS)
ucgaguggga

SEQ ID NO: 1409 - RNA, 10 nt, Artificial Sequence
  intronic recognition element for splicing modifier (REMS)
  misc_feature (2)..(2): n is a, c, g, or u
gngaguggga

SEQ ID NO: 1410 - RNA, 10 nt, Artificial Sequence
  intronic recognition element for splicing modifier (REMS)
  misc_feature (1)..(1): n is a, c, g, or u
nggaguggga

SEQ ID NO: 1411 - RNA, 10 nt, Artificial Sequence
  intronic recognition element for splicing modifier (REMS)
aggaguggga

SEQ ID NO: 1412 - RNA, 10 nt, Artificial Sequence
  intronic recognition element for splicing modifier (REMS)
cggaguggga

SEQ ID NO: 1413 - RNA, 10 nt, Artificial Sequence
  intronic recognition element for splicing modifier (REMS)
gggaguggga

SEQ ID NO: 1414 - RNA, 10 nt, Artificial Sequence
  intronic recognition element for splicing modifier (REMS)
uggaguggga

SEQ ID NO: 1415 - RNA, 10 nt, Artificial Sequence
  intronic recognition element for splicing modifier (REMS)
  misc_feature (2)..(2): n is a, c, g, or u
ungaguggga

SEQ ID NO: 1416 - RNA, 10 nt, Artificial Sequence
  intronic recognition element for splicing modifier (REMS)
  misc_feature (1)..(1): n is a, c, g, or u
nugaguggga

SEQ ID NO: 1417 - RNA, 10 nt, Artificial Sequence
  intronic recognition element for splicing modifier (REMS)
augaguggga

SEQ ID NO: 1418 - RNA, 10 nt, Artificial Sequence
  intronic recognition element for splicing modifier (REMS)
cugaguggga

SEQ ID NO: 1419 - RNA, 10 nt, Artificial Sequence
  intronic recognition element for splicing modifier (REMS)
gugaguggga

SEQ ID NO: 1420 - RNA, 10 nt, Artificial Sequence
  intronic recognition element for splicing modifier (REMS)
uugaguggga

SEQ ID NO: 1421 - RNA, 10 nt, Artificial Sequence
  intronic recognition element for splicing modifier (REMS)
  misc_feature (2)..(2): n is a, c, g, or u
angaguguga

SEQ ID NO: 1422 - RNA, 10 nt, Artificial Sequence
  intronic recognition element for splicing modifier (REMS)
  misc_feature (1)..(1): n is a, c, g, or u
nagaguguga

SEQ ID NO: 1423 - RNA, 10 nt, Artificial Sequence
  intronic recognition element for splicing modifier (REMS)
aagaguguga

SEQ ID NO: 1424 - RNA, 10 nt, Artificial Sequence
  intronic recognition element for splicing modifier (REMS)
cagaguguga

SEQ ID NO: 1425 - RNA, 10 nt, Artificial Sequence
  intronic recognition element for splicing modifier (REMS)
gagaguguga

SEQ ID NO: 1426 - RNA, 10 nt, Artificial Sequence
  intronic recognition element for splicing modifier (REMS)
uagaguguga

SEQ ID NO: 1427 - RNA, 10 nt, Artificial Sequence
  intronic recognition element for splicing modifier (REMS)
  misc_feature (2)..(2): n is a, c, g, or u
cngaguguga

SEQ ID NO: 1428 - RNA, 10 nt, Artificial Sequence
  intronic recognition element for splicing modifier (REMS)
  misc_feature (1)..(1): n is a, c, g, or u
ncgaguguga

SEQ ID NO: 1429 - RNA, 10 nt, Artificial Sequence
  intronic recognition element for splicing modifier (REMS)
acgaguguga

SEQ ID NO: 1430 - RNA, 10 nt, Artificial Sequence
  intronic recognition element for splicing modifier (REMS)
ccgaguguga

SEQ ID NO: 1431 - RNA, 10 nt, Artificial Sequence
  intronic recognition element for splicing modifier (REMS)
gcgaguguga

SEQ ID NO: 1432 - RNA, 10 nt, Artificial Sequence
  intronic recognition element for splicing modifier (REMS)
ucgaguguga

SEQ ID NO: 1433 - RNA, 10 nt, Artificial Sequence
  intronic recognition element for splicing modifier (REMS)
  misc_feature (2)..(2): n is a, c, g, or u
gngaguguga

SEQ ID NO: 1434 - RNA, 10 nt, Artificial Sequence
  intronic recognition element for splicing modifier (REMS)
  misc_feature (1)..(1): n is a, c, g, or u
nggaguguga

SEQ ID NO: 1435 - RNA, 10 nt, Artificial Sequence
  intronic recognition element for splicing modifier (REMS)
aggaguguga

SEQ ID NO: 1436 - RNA, 10 nt, Artificial Sequence
  intronic recognition element for splicing modifier (REMS)
cggaguguga

SEQ ID NO: 1437 - RNA, 10 nt, Artificial Sequence
  intronic recognition element for splicing modifier (REMS)
gggaguguga

SEQ ID NO: 1438 - RNA, 10 nt, Artificial Sequence
  intronic recognition element for splicing modifier (REMS)
uggaguguga

SEQ ID NO: 1439 - RNA, 10 nt, Artificial Sequence
  intronic recognition element for splicing modifier (REMS)
  misc_feature (2)..(2): n is a, c, g, or u
ungaguguga

SEQ ID NO: 1440 - RNA, 10 nt, Artificial Sequence
  intronic recognition element for splicing modifier (REMS)
  misc_feature (1)..(1): n is a, c, g, or u
nugaguguga

SEQ ID NO: 1441 - RNA, 10 nt, Artificial Sequence
  intronic recognition element for splicing modifier (REMS)
augaguguga

SEQ ID NO: 1442 - RNA, 10 nt, Artificial Sequence
  intronic recognition element for splicing modifier (REMS)
cugaguguga

SEQ ID NO: 1443 - RNA, 10 nt, Artificial Sequence
  intronic recognition element for splicing modifier (REMS)
gugaguguga

SEQ ID NO: 1444 - RNA, 10 nt, Artificial Sequence
  intronic recognition element for splicing modifier (REMS)
uugaguguga

SEQ ID NO: 1445 - RNA, 10 nt, Artificial Sequence
  intronic recognition element for splicing modifier (REMS)
  misc_feature (2)..(2): n is a, c, g, or u
angagugagc

SEQ ID NO: 1446 - RNA, 10 nt, Artificial Sequence
  intronic recognition element for splicing modifier (REMS)
  misc_feature (1)..(1): n is a, c, g, or u
nagagugagc

SEQ ID NO: 1447 - RNA, 10 nt, Artificial Sequence
  intronic recognition element for splicing modifier (REMS)
aagagugagc

SEQ ID NO: 1448 - RNA, 10 nt, Artificial Sequence
  intronic recognition element for splicing modifier (REMS)
cagagugagc

SEQ ID NO: 1449 - RNA, 10 nt, Artificial Sequence
  intronic recognition element for splicing modifier (REMS)
gagagugagc

SEQ ID NO: 1450 - RNA, 10 nt, Artificial Sequence
  intronic recognition element for splicing modifier (REMS)
uagagugagc

SEQ ID NO: 1451 - RNA, 10 nt, Artificial Sequence
  intronic recognition element for splicing modifier (REMS)
  misc_feature (2)..(2): n is a, c, g, or u
cngagugagc

SEQ ID NO: 1452 - RNA, 10 nt, Artificial Sequence
  intronic recognition element for splicing modifier (REMS)
  misc_feature (1)..(1): n is a, c, g, or u
ncgagugagc

SEQ ID NO: 1453 - RNA, 10 nt, Artificial Sequence
  intronic recognition element for splicing modifier (REMS)
acgagugagc

SEQ ID NO: 1454 - RNA, 10 nt, Artificial Sequence
  intronic recognition element for splicing modifier (REMS)
ccgagugagc

SEQ ID NO: 1455 - RNA, 10 nt, Artificial Sequence
  intronic recognition element for splicing modifier (REMS)
gcgagugagc

SEQ ID NO: 1456 - RNA, 10 nt, Artificial Sequence
  intronic recognition element for splicing modifier (REMS)
ucgagugagc

SEQ ID NO: 1457 - RNA, 10 nt, Artificial Sequence
  intronic recognition element for splicing modifier (REMS)
  misc_feature (2)..(2): n is a, c, g, or u
gngagugagc

SEQ ID NO: 1458 - RNA, 10 nt, Artificial Sequence
  intronic recognition element for splicing modifier (REMS)
  misc_feature (1)..(1): n is a, c, g, or u
nggagugagc

SEQ ID NO: 1459 - RNA, 10 nt, Artificial Sequence
  intronic recognition element for splicing modifier (REMS)
aggagugagc

SEQ ID NO: 1460 - RNA, 10 nt, Artificial Sequence
  intronic recognition element for splicing modifier (REMS)
cggagugagc

SEQ ID NO: 1461 - RNA, 10 nt, Artificial Sequence
  intronic recognition element for splicing modifier (REMS)
gggagugagc

SEQ ID NO: 1462 - RNA, 10 nt, Artificial Sequence
  intronic recognition element for splicing modifier (REMS)
uggagugagc

SEQ ID NO: 1463 - RNA, 10 nt, Artificial Sequence
  intronic recognition element for splicing modifier (REMS)
  misc_feature (2)..(2): n is a, c, g, or u
ungagugagc

SEQ ID NO: 1464 - RNA, 10 nt, Artificial Sequence
  intronic recognition element for splicing modifier (REMS)
  misc_feature (1)..(1): n is a, c, g, or u
nugagugagc

SEQ ID NO: 1465 - RNA, 10 nt, Artificial Sequence
  intronic recognition element for splicing modifier (REMS)
augagugagc

SEQ ID NO: 1466 - RNA, 10 nt, Artificial Sequence
  intronic recognition element for splicing modifier (REMS)
cugagugagc

SEQ ID NO: 1467 - RNA, 10 nt, Artificial Sequence
  intronic recognition element for splicing modifier (REMS)
gugagugagc

SEQ ID NO: 1468 - RNA, 10 nt, Artificial Sequence
  intronic recognition element for splicing modifier (REMS)
uugagugagc

SEQ ID NO: 1469 - RNA, 10 nt, Artificial Sequence
  intronic recognition element for splicing modifier (REMS)
  misc_feature (2)..(2): n is a, c, g, or u
angagugcgc

SEQ ID NO: 1470 - RNA, 10 nt, Artificial Sequence
  intronic recognition element for splicing modifier (REMS)
  misc_feature (1)..(1): n is a, c, g, or u
nagagugcgc

SEQ ID NO: 1471 - RNA, 10 nt, Artificial Sequence
  intronic recognition element for splicing modifier (REMS)
aagagugcgc

SEQ ID NO: 1472 - RNA, 10 nt, Artificial Sequence
  intronic recognition element for splicing modifier (REMS)
cagagugcgc

SEQ ID NO: 1473 - RNA, 10 nt, Artificial Sequence
  intronic recognition element for splicing modifier (REMS)
gagagugcgc

SEQ ID NO: 1474 - RNA, 10 nt, Artificial Sequence
  intronic recognition element for splicing modifier (REMS)
uagagugcgc

SEQ ID NO: 1475 - RNA, 10 nt, Artificial Sequence
  intronic recognition element for splicing modifier (REMS)
  misc_feature (2)..(2): n is a, c, g, or u
cngagugcgc

SEQ ID NO: 1476 - RNA, 10 nt, Artificial Sequence
  intronic recognition element for splicing modifier (REMS)
  misc_feature (1)..(1): n is a, c, g, or u
ncgagugcgc

SEQ ID NO: 1477 - RNA, 10 nt, Artificial Sequence
  intronic recognition element for splicing modifier (REMS)
acgagugcgc

SEQ ID NO: 1478 - RNA, 10 nt, Artificial Sequence
  intronic recognition element for splicing modifier (REMS)
ccgagugcgc

SEQ ID NO: 1479 - RNA, 10 nt, Artificial Sequence
  intronic recognition element for splicing modifier (REMS)
gcgagugcgc

SEQ ID NO: 1480 - RNA, 10 nt, Artificial Sequence
  intronic recognition element for splicing modifier (REMS)
ucgagugcgc

SEQ ID NO: 1481 - RNA, 10 nt, Artificial Sequence
  intronic recognition element for splicing modifier (REMS)
  misc_feature (2)..(2): n is a, c, g, or u
gngagugcgc

SEQ ID NO: 1482 - RNA, 10 nt, Artificial Sequence
  intronic recognition element for splicing modifier (REMS)
  misc_feature (1)..(1): n is a, c, g, or u
nggagugcgc

SEQ ID NO: 1483 - RNA, 10 nt, Artificial Sequence
  intronic recognition element for splicing modifier (REMS)
aggagugcgc

SEQ ID NO: 1484 - RNA, 10 nt, Artificial Sequence
  intronic recognition element for splicing modifier (REMS)
cggagugcgc

SEQ ID NO: 1485 - RNA, 10 nt, Artificial Sequence
  intronic recognition element for splicing modifier (REMS)
gggagugcgc

SEQ ID NO: 1486 - RNA, 10 nt, Artificial Sequence
  intronic recognition element for splicing modifier (REMS)
uggagugcgc

SEQ ID NO: 1487 - RNA, 10 nt, Artificial Sequence
  intronic recognition element for splicing modifier (REMS)
  misc_feature (2)..(2): n is a, c, g, or u
ungagugcgc

SEQ ID NO: 1488 - RNA, 10 nt, Artificial Sequence
  intronic recognition element for splicing modifier (REMS)
  misc_feature (1)..(1): n is a, c, g, or u
nugagugcgc

SEQ ID NO: 1489 - RNA, 10 nt, Artificial Sequence
  intronic recognition element for splicing modifier (REMS)
augagugcgc

SEQ ID NO: 1490 - RNA, 10 nt, Artificial Sequence
  intronic recognition element for splicing modifier (REMS)
cugagugcgc

SEQ ID NO: 1491 - RNA, 10 nt, Artificial Sequence
  intronic recognition element for splicing modifier (REMS)
gugagugcgc

SEQ ID NO: 1492 - RNA, 10 nt, Artificial Sequence
  intronic recognition element for splicing modifier (REMS)
uugagugcgc

SEQ ID NO: 1493 - RNA, 10 nt, Artificial Sequence
  intronic recognition element for splicing modifier (REMS)
  misc_feature (2)..(2): n is a, c, g, or u
angagugggc

SEQ ID NO: 1494 - RNA, 10 nt, Artificial Sequence
  intronic recognition element for splicing modifier (REMS)
  misc_feature (1)..(1): n is a, c, g, or u
nagagugggc

SEQ ID NO: 1495 - RNA, 10 nt, Artificial Sequence
  intronic recognition element for splicing modifier (REMS)
aagagugggc

SEQ ID NO: 1496 - RNA, 10 nt, Artificial Sequence
  intronic recognition element for splicing modifier (REMS)
cagagugggc

SEQ ID NO: 1497 - RNA, 10 nt, Artificial Sequence
  intronic recognition element for splicing modifier (REMS)
gagagugggc

SEQ ID NO: 1498 - RNA, 10 nt, Artificial Sequence
  intronic recognition element for splicing modifier (REMS)
uagagugggc

SEQ ID NO: 1499 - RNA, 10 nt, Artificial Sequence
  intronic recognition element for splicing modifier (REMS)
  misc_feature (2)..(2): n is a, c, g, or u
cngagugggc

SEQ ID NO: 1500 - RNA, 10 nt, Artificial Sequence
  intronic recognition element for splicing modifier (REMS)
  misc_feature (1)..(1): n is a, c, g, or u
ncgagugggc

SEQ ID NO: 1501 - RNA, 10 nt, Artificial Sequence
  intronic recognition element for splicing modifier (REMS)
acgagugggc

SEQ ID NO: 1502 - RNA, 10 nt, Artificial Sequence
  intronic recognition element for splicing modifier (REMS)
ccgagugggc

SEQ ID NO: 1503 - RNA, 10 nt, Artificial Sequence
  intronic recognition element for splicing modifier (REMS)
gcgagugggc

SEQ ID NO: 1504 - RNA, 10 nt, Artificial Sequence
  intronic recognition element for splicing modifier (REMS)
ucgagugggc

SEQ ID NO: 1505 - RNA, 10 nt, Artificial Sequence
  intronic recognition element for splicing modifier (REMS)
  misc_feature (2)..(2): n is a, c, g, or u
gngagugggc

SEQ ID NO: 1506 - RNA, 10 nt, Artificial Sequence
  intronic recognition element for splicing modifier (REMS)
  misc_feature (1)..(1): n is a, c, g, or u
nggagugggc

SEQ ID NO: 1507 - RNA, 10 nt, Artificial Sequence
  intronic recognition element for splicing modifier (REMS)
aggagugggc

SEQ ID NO: 1508 - RNA, 10 nt, Artificial Sequence
  intronic recognition element for splicing modifier (REMS)
cggagugggc

SEQ ID NO: 1509 - RNA, 10 nt, Artificial Sequence
  intronic recognition element for splicing modifier (REMS)
gggagugggc

SEQ ID NO: 1510 - RNA, 10 nt, Artificial Sequence
  intronic recognition element for splicing modifier (REMS)
uggagugggc

SEQ ID NO: 1511 - RNA, 10 nt, Artificial Sequence
  intronic recognition element for splicing modifier (REMS)
  misc_feature (2)..(2): n is a, c, g, or u
ungagugggc

SEQ ID NO: 1512 - RNA, 10 nt, Artificial Sequence
  intronic recognition element for splicing modifier (REMS)
  misc_feature (1)..(1): n is a, c, g, or u
nugagugggc

SEQ ID NO: 1513 - RNA, 10 nt, Artificial Sequence
  intronic recognition element for splicing modifier (REMS)
augagugggc

SEQ ID NO: 1514 - RNA, 10 nt, Artificial Sequence
  intronic recognition element for splicing modifier (REMS)
cugagugggc

SEQ ID NO: 1515 - RNA, 10 nt, Artificial Sequence
  intronic recognition element for splicing modifier (REMS)
gugagugggc

SEQ ID NO: 1516 - RNA, 10 nt, Artificial Sequence
  intronic recognition element for splicing modifier (REMS)
uugagugggc

SEQ ID NO: 1517 - RNA, 10 nt, Artificial Sequence
  intronic recognition element for splicing modifier (REMS)
  misc_feature (2)..(2): n is a, c, g, or u
angagugugc

SEQ ID NO: 1518 - RNA, 10 nt, Artificial Sequence
  intronic recognition element for splicing modifier (REMS)
  misc_feature (1)..(1): n is a, c, g, or u
nagagugugc

SEQ ID NO: 1519 - RNA, 10 nt, Artificial Sequence
  intronic recognition element for splicing modifier (REMS)
aagagugugc

SEQ ID NO: 1520 - RNA, 10 nt, Artificial Sequence
  intronic recognition element for splicing modifier (REMS)
cagagugugc

SEQ ID NO: 1521 - RNA, 10 nt, Artificial Sequence
  intronic recognition element for splicing modifier (REMS)
gagagugugc

SEQ ID NO: 1522 - RNA, 10 nt, Artificial Sequence
  intronic recognition element for splicing modifier (REMS)
uagagugugc

SEQ ID NO: 1523 - RNA, 10 nt, Artificial Sequence
  intronic recognition element for splicing modifier (REMS)
  misc_feature (2)..(2): n is a, c, g, or u
cngagugugc

SEQ ID NO: 1524 - RNA, 10 nt, Artificial Sequence
  intronic recognition element for splicing modifier (REMS)
  misc_feature (1)..(1): n is a, c, g, or u
ncgagugugc

SEQ ID NO: 1525 - RNA, 10 nt, Artificial Sequence
  intronic recognition element for splicing modifier (REMS)
acgagugugc

SEQ ID NO: 1526 - RNA, 10 nt, Artificial Sequence
  intronic recognition element for splicing modifier (REMS)
ccgagugugc

SEQ ID NO: 1527 - RNA, 10 nt, Artificial Sequence
  intronic recognition element for splicing modifier (REMS)
gcgagugugc

SEQ ID NO: 1528 - RNA, 10 nt, Artificial Sequence
  intronic recognition element for splicing modifier (REMS)
ucgagugugc

SEQ ID NO: 1529 - RNA, 10 nt, Artificial Sequence
  intronic recognition element for splicing modifier (REMS)
  misc_feature (2)..(2): n is a, c, g, or u
gngagugugc

SEQ ID NO: 1530 - RNA, 10 nt, Artificial Sequence
  intronic recognition element for splicing modifier (REMS)
  misc_feature (1)..(1): n is a, c, g, or u
nggagugugc

SEQ ID NO: 1531 - RNA, 10 nt, Artificial Sequence
  intronic recognition element for splicing modifier (REMS)
aggagugugc

SEQ ID NO: 1532 - RNA, 10 nt, Artificial Sequence
  intronic recognition element for splicing modifier (REMS)
cggagugugc

SEQ ID NO: 1533 - RNA, 10 nt, Artificial Sequence
  intronic recognition element for splicing modifier (REMS)
gggagugugc

SEQ ID NO: 1534 - RNA, 10 nt, Artificial Sequence
  intronic recognition element for splicing modifier (REMS)
uggagugugc

SEQ ID NO: 1535 - RNA, 10 nt, Artificial Sequence
  intronic recognition element for splicing modifier (REMS)
  misc_feature (2)..(2): n is a, c, g, or u
ungagugugc

SEQ ID NO: 1536 - RNA, 10 nt, Artificial Sequence
  intronic recognition element for splicing modifier (REMS)
  misc_feature (1)..(1): n is a, c, g, or u
nugagugugc

SEQ ID NO: 1537 - RNA, 10 nt, Artificial Sequence
  intronic recognition element for splicing modifier (REMS)
augagugugc

SEQ ID NO: 1538 - RNA, 10 nt, Artificial Sequence
  intronic recognition element for splicing modifier (REMS)
cugagugugc

SEQ ID NO: 1539 - RNA, 10 nt, Artificial Sequence
  intronic recognition element for splicing modifier (REMS)
gugagugugc

SEQ ID NO: 1540 - RNA, 10 nt, Artificial Sequence
  intronic recognition element for splicing modifier (REMS)
uugagugugc

SEQ ID NO: 1541 - RNA, 10 nt, Artificial Sequence
  intronic recognition element for splicing modifier (REMS)
  misc_feature (2)..(2): n is a, c, g, or u
angagugagg

SEQ ID NO: 1542 - RNA, 10 nt, Artificial Sequence
  intronic recognition element for splicing modifier (REMS)
  misc_feature (1)..(1): n is a, c, g, or u
nagagugagg

SEQ ID NO: 1543 - RNA, 10 nt, Artificial Sequence
  intronic recognition element for splicing modifier (REMS)
aagagugagg

SEQ ID NO: 1544 - RNA, 10 nt, Artificial Sequence
  intronic recognition element for splicing modifier (REMS)
cagagugagg

SEQ ID NO: 1545 - RNA, 10 nt, Artificial Sequence
  intronic recognition element for splicing modifier (REMS)
gagagugagg

SEQ ID NO: 1546 - RNA, 10 nt, Artificial Sequence
  intronic recognition element for splicing modifier (REMS)
uagagugagg

SEQ ID NO: 1547 - RNA, 10 nt, Artificial Sequence
  intronic recognition element for splicing modifier (REMS)
  misc_feature (2)..(2): n is a, c, g, or u
cngagugagg

SEQ ID NO: 1548 - RNA, 10 nt, Artificial Sequence
  intronic recognition element for splicing modifier (REMS)
  misc_feature (1)..(1): n is a, c, g, or u
ncgagugagg

SEQ ID NO: 1549 - RNA, 10 nt, Artificial Sequence
  intronic recognition element for splicing modifier (REMS)
acgagugagg

SEQ ID NO: 1550 - RNA, 10 nt, Artificial Sequence
  intronic recognition element for splicing modifier (REMS)
ccgagugagg

SEQ ID NO: 1551 - RNA, 10 nt, Artificial Sequence
  intronic recognition element for splicing modifier (REMS)
gcgagugagg

SEQ ID NO: 1552 - RNA, 10 nt, Artificial Sequence
  intronic recognition element for splicing modifier (REMS)
ucgagugagg

SEQ ID NO: 1553 - RNA, 10 nt, Artificial Sequence
  intronic recognition element for splicing modifier (REMS)
  misc_feature (2)..(2): n is a, c, g, or u
gngagugagg

SEQ ID NO: 1554 - RNA, 10 nt, Artificial Sequence
  intronic recognition element for splicing modifier (REMS)
  misc_feature (1)..(1): n is a, c, g, or u
nggagugagg

SEQ ID NO: 1555 - RNA, 10 nt, Artificial Sequence
  intronic recognition element for splicing modifier (REMS)
aggagugagg

SEQ ID NO: 1556 - RNA, 10 nt, Artificial Sequence
  intronic recognition element for splicing modifier (REMS)
cggagugagg

SEQ ID NO: 1557 - RNA, 10 nt, Artificial Sequence
  intronic recognition element for splicing modifier (REMS)
gggagugagg

SEQ ID NO: 1558 - RNA, 10 nt, Artificial Sequence
  intronic recognition element for splicing modifier (REMS)
uggagugagg

SEQ ID NO: 1559 - RNA, 10 nt, Artificial Sequence
  intronic recognition element for splicing modifier (REMS)
  misc_feature (2)..(2): n is a, c, g, or u
ungagugagg

SEQ ID NO: 1560 - RNA, 10 nt, Artificial Sequence
  intronic recognition element for splicing modifier (REMS)
  misc_feature (1)..(1): n is a, c, g, or u
nugagugagg

SEQ ID NO: 1561 - RNA, 10 nt, Artificial Sequence
  intronic recognition element for splicing modifier (REMS)
augagugagg

SEQ ID NO: 1562 - RNA, 10 nt, Artificial Sequence
  intronic recognition element for splicing modifier (REMS)
cugagugagg

SEQ ID NO: 1563 - RNA, 10 nt, Artificial Sequence
  intronic recognition element for splicing modifier (REMS)
gugagugagg

SEQ ID NO: 1564 - RNA, 10 nt, Artificial Sequence
  intronic recognition element for splicing modifier (REMS)
uugagugagg

SEQ ID NO: 1565 - RNA, 10 nt, Artificial Sequence
  intronic recognition element for splicing modifier (REMS)
  misc_feature (2)..(2): n is a, c, g, or u
angagugcgg

SEQ ID NO: 1566 - RNA, 10 nt, Artificial Sequence
  intronic recognition element for splicing modifier (REMS)
  misc_feature (1)..(1): n is a, c, g, or u
nagagugcgg

SEQ ID NO: 1567 - RNA, 10 nt, Artificial Sequence
  intronic recognition element for splicing modifier (REMS)
aagagugcgg

SEQ ID NO: 1568 - RNA, 10 nt, Artificial Sequence
  intronic recognition element for splicing modifier (REMS)
cagagugcgg

SEQ ID NO: 1569 - RNA, 10 nt, Artificial Sequence
  intronic recognition element for splicing modifier (REMS)
gagagugcgg

SEQ ID NO: 1570 - RNA, 10 nt, Artificial Sequence
  intronic recognition element for splicing modifier (REMS)
uagagugcgg

SEQ ID NO: 1571 - RNA, 10 nt, Artificial Sequence
  intronic recognition element for splicing modifier (REMS)
  misc_feature (2)..(2): n is a, c, g, or u
cngagugcgg

SEQ ID NO: 1572 - RNA, 10 nt, Artificial Sequence
  intronic recognition element for splicing modifier (REMS)
  misc_feature (1)..(1): n is a, c, g, or u
ncgagugcgg

SEQ ID NO: 1573 - RNA, 10 nt, Artificial Sequence
  intronic recognition element for splicing modifier (REMS)
acgagugcgg

SEQ ID NO: 1574 - RNA, 10 nt, Artificial Sequence
  intronic recognition element for splicing modifier (REMS)
ccgagugcgg

SEQ ID NO: 1575 - RNA, 10 nt, Artificial Sequence
  intronic recognition element for splicing modifier (REMS)
gcgagugcgg

SEQ ID NO: 1576 - RNA, 10 nt, Artificial Sequence
  intronic recognition element for splicing modifier (REMS)
ucgagugcgg

SEQ ID NO: 1577 - RNA, 10 nt, Artificial Sequence
  intronic recognition element for splicing modifier (REMS)
  misc_feature (2)..(2): n is a, c, g, or u
gngagugcgg

SEQ ID NO: 1578 - RNA, 10 nt, Artificial Sequence
  intronic recognition element for splicing modifier (REMS)
  misc_feature (1)..(1): n is a, c, g, or u
nggagugcgg

SEQ ID NO: 1579 - RNA, 10 nt, Artificial Sequence
  intronic recognition element for splicing modifier (REMS)
aggagugcgg

SEQ ID NO: 1580 - RNA, 10 nt, Artificial Sequence
  intronic recognition element for splicing modifier (REMS)
cggagugcgg

SEQ ID NO: 1581 - RNA, 10 nt, Artificial Sequence
  intronic recognition element for splicing modifier (REMS)
gggagugcgg

SEQ ID NO: 1582 - RNA, 10 nt, Artificial Sequence
  intronic recognition element for splicing modifier (REMS)
uggagugcgg

SEQ ID NO: 1583 - RNA, 10 nt, Artificial Sequence
  intronic recognition element for splicing modifier (REMS)
  misc_feature (2)..(2): n is a, c, g, or u
ungagugcgg

SEQ ID NO: 1584 - RNA, 10 nt, Artificial Sequence
  intronic recognition element for splicing modifier (REMS)
  misc_feature (1)..(1): n is a, c, g, or u
nugagugcgg

SEQ ID NO: 1585 - RNA, 10 nt, Artificial Sequence
  intronic recognition element for splicing modifier (REMS)
augagugcgg

SEQ ID NO: 1586 - RNA, 10 nt, Artificial Sequence
  intronic recognition element for splicing modifier (REMS)
cugagugcgg

SEQ ID NO: 1587 - RNA, 10 nt, Artificial Sequence
  intronic recognition element for splicing modifier (REMS)
gugagugcgg

SEQ ID NO: 1588 - RNA, 10 nt, Artificial Sequence
  intronic recognition element for splicing modifier (REMS)
uugagugcgg

SEQ ID NO: 1589 - RNA, 10 nt, Artificial Sequence
  intronic recognition element for splicing modifier (REMS)
  misc_feature (2)..(2): n is a, c, g, or u
angagugggg

SEQ ID NO: 1590 - RNA, 10 nt, Artificial Sequence
  intronic recognition element for splicing modifier (REMS)
  misc_feature (1)..(1): n is a, c, g, or u
nagagugggg

SEQ ID NO: 1591 - RNA, 10 nt, Artificial Sequence
  intronic recognition element for splicing modifier (REMS)
aagagugggg

SEQ ID NO: 1592 - RNA, 10 nt, Artificial Sequence
  intronic recognition element for splicing modifier (REMS)
cagagugggg

SEQ ID NO: 1593 - RNA, 10 nt, Artificial Sequence
  intronic recognition element for splicing modifier (REMS)
gagagugggg

SEQ ID NO: 1594 - RNA, 10 nt, Artificial Sequence
  intronic recognition element for splicing modifier (REMS)
uagagugggg

SEQ ID NO: 1595 - RNA, 10 nt, Artificial Sequence
  intronic recognition element for splicing modifier (REMS)
  misc_feature (2)..(2): n is a, c, g, or u
cngagugggg

SEQ ID NO: 1596 - RNA, 10 nt, Artificial Sequence
  intronic recognition element for splicing modifier (REMS)
  misc_feature (1)..(1): n is a, c, g, or u
ncgagugggg

SEQ ID NO: 1597 - RNA, 10 nt, Artificial Sequence
  intronic recognition element for splicing modifier (REMS)
acgagugggg

SEQ ID NO: 1598 - RNA, 10 nt, Artificial Sequence
  intronic recognition element for splicing modifier (REMS)
ccgagugggg

SEQ ID NO: 1599 - RNA, 10 nt, Artificial Sequence
  intronic recognition element for splicing modifier (REMS)
gcgagugggg

SEQ ID NO: 1600 - RNA, 10 nt, Artificial Sequence
  intronic recognition element for splicing modifier (REMS)
ucgagugggg

SEQ ID NO: 1601 - RNA, 10 nt, Artificial Sequence
  intronic recognition element for splicing modifier (REMS)
  misc_feature (2)..(2): n is a, c, g, or u
gngagugggg

SEQ ID NO: 1602 - RNA, 10 nt, Artificial Sequence
  intronic recognition element for splicing modifier (REMS)
  misc_feature (1)..(1): n is a, c, g, or u
nggagugggg

SEQ ID NO: 1603 - RNA, 10 nt, Artificial Sequence
  intronic recognition element for splicing modifier (REMS)
aggagugggg

SEQ ID NO: 1604 - RNA, 10 nt, Artificial Sequence
  intronic recognition element for splicing modifier (REMS)
cggagugggg

SEQ ID NO: 1605 - RNA, 10 nt, Artificial Sequence
  intronic recognition element for splicing modifier (REMS)
gggagugggg

SEQ ID NO: 1606 - RNA, 10 nt, Artificial Sequence
  intronic recognition element for splicing modifier (REMS)
uggagugggg

SEQ ID NO: 1607 - RNA, 10 nt, Artificial Sequence
  intronic recognition element for splicing modifier (REMS)
  misc_feature (2)..(2): n is a, c, g, or u
ungagugggg

SEQ ID NO: 1608 - RNA, 10 nt, Artificial Sequence
  intronic recognition element for splicing modifier (REMS)
  misc_feature (1)..(1): n is a, c, g, or u
nugagugggg

SEQ ID NO: 1609 - RNA, 10 nt, Artificial Sequence
  intronic recognition element for splicing modifier (REMS)
augagugggg

SEQ ID NO: 1610 - RNA, 10 nt, Artificial Sequence
  intronic recognition element for splicing modifier (REMS)
cugagugggg

SEQ ID NO: 1611 - RNA, 10 nt, Artificial Sequence
  intronic recognition element for splicing modifier (REMS)
gugagugggg

SEQ ID NO: 1612 - RNA, 10 nt, Artificial Sequence
  intronic recognition element for splicing modifier (REMS)
uugagugggg

SEQ ID NO: 1613 - RNA, 10 nt, Artificial Sequence
  intronic recognition element for splicing modifier (REMS)
  misc_feature (2)..(2): n is a, c, g, or u
angagugugg

SEQ ID NO: 1614 - RNA, 10 nt, Artificial Sequence
  intronic recognition element for splicing modifier (REMS)
  misc_feature (1)..(1): n is a, c, g, or u
nagagugugg

SEQ ID NO: 1615 - RNA, 10 nt, Artificial Sequence
  intronic recognition element for splicing modifier (REMS)
aagagugugg

SEQ ID NO: 1616 - RNA, 10 nt, Artificial Sequence
  intronic recognition element for splicing modifier (REMS)
cagagugugg

SEQ ID NO: 1617 - RNA, 10 nt, Artificial Sequence
  intronic recognition element for splicing modifier (REMS)
gagagugugg

SEQ ID NO: 1618 - RNA, 10 nt, Artificial Sequence
  intronic recognition element for splicing modifier (REMS)
uagagugugg

SEQ ID NO: 1619 - RNA, 10 nt, Artificial Sequence
  intronic recognition element for splicing modifier (REMS)
  misc_feature (2)..(2): n is a, c, g, or u
cngagugugg

SEQ ID NO: 1620 - RNA, 10 nt, Artificial Sequence
  intronic recognition element for splicing modifier (REMS)
  misc_feature (1)..(1): n is a, c, g, or u
ncgagugugg

SEQ ID NO: 1621 - RNA, 10 nt, Artificial Sequence
  intronic recognition element for splicing modifier (REMS)
acgagugugg

SEQ ID NO: 1622 - RNA, 10 nt, Artificial Sequence
  intronic recognition element for splicing modifier (REMS)
ccgagugugg

SEQ ID NO: 1623 - RNA, 10 nt, Artificial Sequence
  intronic recognition element for splicing modifier (REMS)
gcgagugugg

SEQ ID NO: 1624 - RNA, 10 nt, Artificial Sequence
  intronic recognition element for splicing modifier (REMS)
ucgagugugg

SEQ ID NO: 1625 - RNA, 10 nt, Artificial Sequence
  intronic recognition element for splicing modifier (REMS)
  misc_feature (2)..(2): n is a, c, g, or u
gngagugugg

SEQ ID NO: 1626 - RNA, 10 nt, Artificial Sequence
  intronic recognition element for splicing modifier (REMS)
  misc_feature (1)..(1): n is a, c, g, or u
nggagugugg

SEQ ID NO: 1627 - RNA, 10 nt, Artificial Sequence
  intronic recognition element for splicing modifier (REMS)
aggagugugg

SEQ ID NO: 1628 - RNA, 10 nt, Artificial Sequence
  intronic recognition element for splicing modifier (REMS)
cggagugugg

SEQ ID NO: 1629 - RNA, 10 nt, Artificial Sequence
  intronic recognition element for splicing modifier (REMS)
gggagugugg

SEQ ID NO: 1630 - RNA, 10 nt, Artificial Sequence
  intronic recognition element for splicing modifier (REMS)
uggagugugg

SEQ ID NO: 1631 - RNA, 10 nt, Artificial Sequence
  intronic recognition element for splicing modifier (REMS)
  misc_feature (2)..(2): n is a, c, g, or u
ungagugugg

SEQ ID NO: 1632 - RNA, 10 nt, Artificial Sequence
  intronic recognition element for splicing modifier (REMS)
  misc_feature (1)..(1): n is a, c, g, or u
nugagugugg

SEQ ID NO: 1633 - RNA, 10 nt, Artificial Sequence
  intronic recognition element for splicing modifier (REMS)
augagugugg

SEQ ID NO: 1634 - RNA, 10 nt, Artificial Sequence
  intronic recognition element for splicing modifier (REMS)
cugagugugg

SEQ ID NO: 1635 - RNA, 10 nt, Artificial Sequence
  intronic recognition element for splicing modifier (REMS)
gugagugugg

SEQ ID NO: 1636 - RNA, 10 nt, Artificial Sequence
  intronic recognition element for splicing modifier (REMS)
uugagugugg

SEQ ID NO: 1637 - RNA, 10 nt, Artificial Sequence
  intronic recognition element for splicing modifier (REMS)
  misc_feature (2)..(2): n is a, c, g, or u
angagugagu

SEQ ID NO: 1638 - RNA, 10 nt, Artificial Sequence
  intronic recognition element for splicing modifier (REMS)
  misc_feature (1)..(1): n is a, c, g, or u
nagagugagu

SEQ ID NO: 1639 - RNA, 10 nt, Artificial Sequence
  intronic recognition element for splicing modifier (REMS)
aagagugagu

SEQ ID NO: 1640 - RNA, 10 nt, Artificial Sequence
  intronic recognition element for splicing modifier (REMS)
cagagugagu

SEQ ID NO: 1641 - RNA, 10 nt, Artificial Sequence
  intronic recognition element for splicing modifier (REMS)
gagagugagu

SEQ ID NO: 1642 - RNA, 10 nt, Artificial Sequence
  intronic recognition element for splicing modifier (REMS)
uagagugagu

SEQ ID NO: 1643 - RNA, 10 nt, Artificial Sequence
  intronic recognition element for splicing modifier (REMS)
  misc_feature (2)..(2): n is a, c, g, or u
cngagugagu

SEQ ID NO: 1644 - RNA, 10 nt, Artificial Sequence
  intronic recognition element for splicing modifier (REMS)
  misc_feature (1)..(1): n is a, c, g, or u
ncgagugagu

SEQ ID NO: 1645 - RNA, 10 nt, Artificial Sequence
  intronic recognition element for splicing modifier (REMS)
acgagugagu

SEQ ID NO: 1646 - RNA, 10 nt, Artificial Sequence
  intronic recognition element for splicing modifier (REMS)
ccgagugagu

SEQ ID NO: 1647 - RNA, 10 nt, Artificial Sequence
  intronic recognition element for splicing modifier (REMS)
gcgagugagu

SEQ ID NO: 1648 - RNA, 10 nt, Artificial Sequence
  intronic recognition element for splicing modifier (REMS)
ucgagugagu

SEQ ID NO: 1649 - RNA, 10 nt, Artificial Sequence
  intronic recognition element for splicing modifier (REMS)
  misc_feature (2)..(2): n is a, c, g, or u
gngagugagu

SEQ ID NO: 1650 - RNA, 10 nt, Artificial Sequence
  intronic recognition element for splicing modifier (REMS)
  misc_feature (1)..(1): n is a, c, g, or u
nggagugagu

SEQ ID NO: 1651 - RNA, 10 nt, Artificial Sequence
  intronic recognition element for splicing modifier (REMS)
aggagugagu

SEQ ID NO: 1652 - RNA, 10 nt, Artificial Sequence
  intronic recognition element for splicing modifier (REMS)
cggagugagu

SEQ ID NO: 1653 - RNA, 10 nt, Artificial Sequence
  intronic recognition element for splicing modifier (REMS)
gggagugagu

SEQ ID NO: 1654 - RNA, 10 nt, Artificial Sequence
  intronic recognition element for splicing modifier (REMS)
uggagugagu

SEQ ID NO: 1655 - RNA, 10 nt, Artificial Sequence
  intronic recognition element for splicing modifier (REMS)
  misc_feature (2)..(2): n is a, c, g, or u
ungagugagu

SEQ ID NO: 1656 - RNA, 10 nt, Artificial Sequence
  intronic recognition element for splicing modifier (REMS)
  misc_feature (1)..(1): n is a, c, g, or u
nugagugagu

SEQ ID NO: 1657 - RNA, 10 nt, Artificial Sequence
  intronic recognition element for splicing modifier (REMS)
augagugagu

SEQ ID NO: 1658 - RNA, 10 nt, Artificial Sequence
  intronic recognition element for splicing modifier (REMS)
cugagugagu

SEQ ID NO: 1659 - RNA, 10 nt, Artificial Sequence
  intronic recognition element for splicing modifier (REMS)
gugagugagu

SEQ ID NO: 1660 - RNA, 10 nt, Artificial Sequence
  intronic recognition element for splicing modifier (REMS)
uugagugagu

SEQ ID NO: 1661 - RNA, 10 nt, Artificial Sequence
  intronic recognition element for splicing modifier (REMS)
  misc_feature (2)..(2): n is a, c, g, or u
angagugcgu

SEQ ID NO: 1662 - RNA, 10 nt, Artificial Sequence
  intronic recognition element for splicing modifier (REMS)
  misc_feature (1)..(1): n is a, c, g, or u
nagagugcgu

SEQ ID NO: 1663 - RNA, 10 nt, Artificial Sequence
  intronic recognition element for splicing modifier (REMS)
aagagugcgu

SEQ ID NO: 1664 - RNA, 10 nt, Artificial Sequence
  intronic recognition element for splicing modifier (REMS)
cagagugcgu

SEQ ID NO: 1665 - RNA, 10 nt, Artificial Sequence
  intronic recognition element for splicing modifier (REMS)
gagagugcgu

SEQ ID NO: 1666 - RNA, 10 nt, Artificial Sequence
  intronic recognition element for splicing modifier (REMS)
uagagugcgu

SEQ ID NO: 1667 - RNA, 10 nt, Artificial Sequence
  intronic recognition element for splicing modifier (REMS)
  misc_feature (2)..(2): n is a, c, g, or u
cngagugcgu

SEQ ID NO: 1668 - RNA, 10 nt, Artificial Sequence
  intronic recognition element for splicing modifier (REMS)
  misc_feature (1)..(1): n is a, c, g, or u
ncgagugcgu

SEQ ID NO: 1669 - RNA, 10 nt, Artificial Sequence
  intronic recognition element for splicing modifier (REMS)
acgagugcgu

SEQ ID NO: 1670 - RNA, 10 nt, Artificial Sequence
  intronic recognition element for splicing modifier (REMS)
ccgagugcgu

SEQ ID NO: 1671 - RNA, 10 nt, Artificial Sequence
  intronic recognition element for splicing modifier (REMS)
gcgagugcgu

SEQ ID NO: 1672 - RNA, 10 nt, Artificial Sequence
  intronic recognition element for splicing modifier (REMS)
ucgagugcgu

SEQ ID NO: 1673 - RNA, 10 nt, Artificial Sequence
  intronic recognition element for splicing modifier (REMS)
  misc_feature (2)..(2): n is a, c, g, or u
gngagugcgu

SEQ ID NO: 1674 - RNA, 10 nt, Artificial Sequence
  intronic recognition element for splicing modifier (REMS)
  misc_feature (1)..(1): n is a, c, g, or u
nggagugcgu

SEQ ID NO: 1675 - RNA, 10 nt, Artificial Sequence
  intronic recognition element for splicing modifier (REMS)
aggagugcgu

SEQ ID NO: 1676 - RNA, 10 nt, Artificial Sequence
  intronic recognition element for splicing modifier (REMS)
cggagugcgu

SEQ ID NO: 1677 - RNA, 10 nt, Artificial Sequence
  intronic recognition element for splicing modifier (REMS)
gggagugcgu

SEQ ID NO: 1678 - RNA, 10 nt, Artificial Sequence
  intronic recognition element for splicing modifier (REMS)
uggagugcgu

SEQ ID NO: 1679 - RNA, 10 nt, Artificial Sequence
  intronic recognition element for splicing modifier (REMS)
  misc_feature (2)..(2): n is a, c, g, or u
ungagugcgu

SEQ ID NO: 1680 - RNA, 10 nt, Artificial Sequence
  intronic recognition element for splicing modifier (REMS)
  misc_feature (1)..(1): n is a, c, g, or u
nugagugcgu

SEQ ID NO: 1681 - RNA, 10 nt, Artificial Sequence
  intronic recognition element for splicing modifier (REMS)
augagugcgu

SEQ ID NO: 1682 - RNA, 10 nt, Artificial Sequence
  intronic recognition element for splicing modifier (REMS)
cugagugcgu

SEQ ID NO: 1683 - RNA, 10 nt, Artificial Sequence
  intronic recognition element for splicing modifier (REMS)
gugagugcgu

SEQ ID NO: 1684 - RNA, 10 nt, Artificial Sequence
  intronic recognition element for splicing modifier (REMS)
uugagugcgu

SEQ ID NO: 1685 - RNA, 10 nt, Artificial Sequence
  intronic recognition element for splicing modifier (REMS)
  misc_feature (2)..(2): n is a, c, g, or u
angagugggu

SEQ ID NO: 1686 - RNA, 10 nt, Artificial Sequence
  intronic recognition element for splicing modifier (REMS)
  misc_feature (1)..(1): n is a, c, g, or u
nagagugggu

SEQ ID NO: 1687 - RNA, 10 nt, Artificial Sequence
  intronic recognition element for splicing modifier (REMS)
aagagugggu

SEQ ID NO: 1688 - RNA, 10 nt, Artificial Sequence
  intronic recognition element for splicing modifier (REMS)
cagagugggu

SEQ ID NO: 1689 - RNA, 10 nt, Artificial Sequence
  intronic recognition element for splicing modifier (REMS)
gagagugggu

SEQ ID NO: 1690 - RNA, 10 nt, Artificial Sequence
  intronic recognition element for splicing modifier (REMS)
uagagugggu

SEQ ID NO: 1691 - RNA, 10 nt, Artificial Sequence
  intronic recognition element for splicing modifier (REMS)
  misc_feature (2)..(2): n is a, c, g, or u
cngagugggu

SEQ ID NO: 1692 - RNA, 10 nt, Artificial Sequence
  intronic recognition element for splicing modifier (REMS)
  misc_feature (1)..(1): n is a, c, g, or u
ncgagugggu

SEQ ID NO: 1693 - RNA, 10 nt, Artificial Sequence
  intronic recognition element for splicing modifier (REMS)
acgagugggu

SEQ ID NO: 1694 - RNA, 10 nt, Artificial Sequence
  intronic recognition element for splicing modifier (REMS)
ccgagugggu

SEQ ID NO: 1695 - RNA, 10 nt, Artificial Sequence
  intronic recognition element for splicing modifier (REMS)
gcgagugggu

SEQ ID NO: 1696 - RNA, 10 nt, Artificial Sequence
  intronic recognition element for splicing modifier (REMS)
ucgagugggu

SEQ ID NO: 1697 - RNA, 10 nt, Artificial Sequence
  intronic recognition element for splicing modifier (REMS)
  misc_feature (2)..(2): n is a, c, g, or u
gngagugggu

SEQ ID NO: 1698 - RNA, 10 nt, Artificial Sequence
  intronic recognition element for splicing modifier (REMS)
  misc_feature (1)..(1): n is a, c, g, or u
nggagugggu

SEQ ID NO: 1699 - RNA, 10 nt, Artificial Sequence
  intronic recognition element for splicing modifier (REMS)
aggagugggu

SEQ ID NO: 1700 - RNA, 10 nt, Artificial Sequence
  intronic recognition element for splicing modifier (REMS)
cggagugggu

SEQ ID NO: 1701 - RNA, 10 nt, Artificial Sequence
  intronic recognition element for splicing modifier (REMS)
gggagugggu

SEQ ID NO: 1702 - RNA, 10 nt, Artificial Sequence
  intronic recognition element for splicing modifier (REMS)
uggagugggu

SEQ ID NO: 1703 - RNA, 10 nt, Artificial Sequence
  intronic recognition element for splicing modifier (REMS)
  misc_feature (2)..(2): n is a, c, g, or u
ungagugggu

SEQ ID NO: 1704 - RNA, 10 nt, Artificial Sequence
  intronic recognition element for splicing modifier (REMS)
  misc_feature (1)..(1): n is a, c, g, or u
nugagugggu

SEQ ID NO: 1705 - RNA, 10 nt, Artificial Sequence
  intronic recognition element for splicing modifier (REMS)
augagugggu

SEQ ID NO: 1706 - RNA, 10 nt, Artificial Sequence
  intronic recognition element for splicing modifier (REMS)
cugagugggu

SEQ ID NO: 1707 - RNA, 10 nt, Artificial Sequence
  intronic recognition element for splicing modifier (REMS)
gugagugggu

SEQ ID NO: 1708 - RNA, 10 nt, Artificial Sequence
  intronic recognition element for splicing modifier (REMS)
uugagugggu

SEQ ID NO: 1709 - RNA, 10 nt, Artificial Sequence
  intronic recognition element for splicing modifier (REMS)
  misc_feature (2)..(2): n is a, c, g, or u
angagugugu

SEQ ID NO: 1710 - RNA, 10 nt, Artificial Sequence
  intronic recognition element for splicing modifier (REMS)
  misc_feature (1)..(1): n is a, c, g, or u
nagagugugu

SEQ ID NO: 1711 - RNA, 10 nt, Artificial Sequence
  intronic recognition element for splicing modifier (REMS)
aagagugugu

SEQ ID NO: 1712 - RNA, 10 nt, Artificial Sequence
  intronic recognition element for splicing modifier (REMS)
cagagugugu

SEQ ID NO: 1713 - RNA, 10 nt, Artificial Sequence
  intronic recognition element for splicing modifier (REMS)
gagagugugu

SEQ ID NO: 1714 - RNA, 10 nt, Artificial Sequence
  intronic recognition element for splicing modifier (REMS)
uagagugugu

SEQ ID NO: 1715 - RNA, 10 nt, Artificial Sequence
  intronic recognition element for splicing modifier (REMS)
  misc_feature (2)..(2): n is a, c, g, or u
cngagugugu

SEQ ID NO: 1716 - RNA, 10 nt, Artificial Sequence
  intronic recognition element for splicing modifier (REMS)
  misc_feature (1)..(1): n is a, c, g, or u
ncgagugugu

SEQ ID NO: 1717 - RNA, 10 nt, Artificial Sequence
  intronic recognition element for splicing modifier (REMS)
acgagugugu

SEQ ID NO: 1718 - RNA, 10 nt, Artificial Sequence
  intronic recognition element for splicing modifier (REMS)
ccgagugugu

SEQ ID NO: 1719 - RNA, 10 nt, Artificial Sequence
  intronic recognition element for splicing modifier (REMS)
gcgagugugu

SEQ ID NO: 1720 - RNA, 10 nt, Artificial Sequence
  intronic recognition element for splicing modifier (REMS)
ucgagugugu

SEQ ID NO: 1721 - RNA, 10 nt, Artificial Sequence
  intronic recognition element for splicing modifier (REMS)
  misc_feature (2)..(2): n is a, c, g, or u
gngagugugu

SEQ ID NO: 1722 - RNA, 10 nt, Artificial Sequence
  intronic recognition element for splicing modifier (REMS)
  misc_feature (1)..(1): n is a, c, g, or u
nggagugugu

SEQ ID NO: 1723 - RNA, 10 nt, Artificial Sequence
  intronic recognition element for splicing modifier (REMS)
aggagugugu

SEQ ID NO: 1724 - RNA, 10 nt, Artificial Sequence
  intronic recognition element for splicing modifier (REMS)
cggagugugu

SEQ ID NO: 1725 - RNA, 10 nt, Artificial Sequence
  intronic recognition element for splicing modifier (REMS)
gggagugugu

SEQ ID NO: 1726 - RNA, 10 nt, Artificial Sequence
  intronic recognition element for splicing modifier (REMS)
uggagugugu

SEQ ID NO: 1727 - RNA, 10 nt, Artificial Sequence
  intronic recognition element for splicing modifier (REMS)
  misc_feature (2)..(2): n is a, c, g, or u
ungagugugu

SEQ ID NO: 1728 - RNA, 10 nt, Artificial Sequence
  intronic recognition element for splicing modifier (REMS)
  misc_feature (1)..(1): n is a, c, g, or u
nugagugugu

SEQ ID NO: 1729 - RNA, 10 nt, Artificial Sequence
  intronic recognition element for splicing modifier (REMS)
augagugugu

SEQ ID NO: 1730 - RNA, 10 nt, Artificial Sequence
  intronic recognition element for splicing modifier (REMS)
cugagugugu

SEQ ID NO: 1731 - RNA, 10 nt, Artificial Sequence
  intronic recognition element for splicing modifier (REMS)
gugagugugu

SEQ ID NO: 1732 - RNA, 10 nt, Artificial Sequence
  intronic recognition element for splicing modifier (REMS)
uugagugugu

SEQ ID NO: 1733 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angagugnga

SEQ ID NO: 1734 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagagugnga

SEQ ID NO: 1735 - RNA, 10 nt, Artificial Sequence
  intronic recognition element for splicing modifier (REMS)
  misc_feature (8)..(8): n is a, c, g, or u
aagagugnga

SEQ ID NO: 1736 - RNA, 10 nt, Artificial Sequence
  intronic recognition element for splicing modifier (REMS)
  misc_feature (8)..(8): n is a, c, g, or u
cagagugnga

SEQ ID NO: 1737 - RNA, 10 nt, Artificial Sequence
  intronic recognition element for splicing modifier (REMS)
  misc_feature (8)..(8): n is a, c, g, or u
gagagugnga

SEQ ID NO: 1738 - RNA, 10 nt, Artificial Sequence
  intronic recognition element for splicing modifier (REMS)
  misc_feature (8)..(8): n is a, c, g, or u
uagagugnga

SEQ ID NO: 1739 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngagugnga

SEQ ID NO: 1740 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgagugnga

SEQ ID NO: 1741 - RNA, 10 nt, Artificial Sequence
  intronic recognition element for splicing modifier (REMS)
  misc_feature (8)..(8): n is a, c, g, or u
acgagugnga

SEQ ID NO: 1742 - RNA, 10 nt, Artificial Sequence
  intronic recognition element for splicing modifier (REMS)
  misc_feature (8)..(8): n is a, c, g, or u
ccgagugnga

SEQ ID NO: 1743 - RNA, 10 nt, Artificial Sequence
  intronic recognition element for splicing modifier (REMS)
  misc_feature (8)..(8): n is a, c, g, or u
gcgagugnga

SEQ ID NO: 1744 - RNA, 10 nt, Artificial Sequence
  intronic recognition element for splicing modifier (REMS)
  misc_feature (8)..(8): n is a, c, g, or u
ucgagugnga

SEQ ID NO: 1745 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngagugnga

SEQ ID NO: 1746 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggagugnga

SEQ ID NO: 1747 - RNA, 10 nt, Artificial Sequence
  intronic recognition element for splicing modifier (REMS)
  misc_feature (8)..(8): n is a, c, g, or u
aggagugnga

SEQ ID NO: 1748 - RNA, 10 nt, Artificial Sequence
  intronic recognition element for splicing modifier (REMS)
  misc_feature (8)..(8): n is a, c, g, or u
cggagugnga

SEQ ID NO: 1749 - RNA, 10 nt, Artificial Sequence
  intronic recognition element for splicing modifier (REMS)
  misc_feature (8)..(8): n is a, c, g, or u
gggagugnga

SEQ ID NO: 1750 - RNA, 10 nt, Artificial Sequence
  intronic recognition element for splicing modifier (REMS)
  misc_feature (8)..(8): n is a, c, g, or u
uggagugnga

SEQ ID NO: 1751 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungagugnga

SEQ ID NO: 1752 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugagugnga

SEQ ID NO: 1753 - RNA, 10 nt, Artificial Sequence
  intronic recognition element for splicing modifier (REMS)
  misc_feature (8)..(8): n is a, c, g, or u
augagugnga

SEQ ID NO: 1754 - RNA, 10 nt, Artificial Sequence
  intronic recognition element for splicing modifier (REMS)
  misc_feature (8)..(8): n is a, c, g, or u
cugagugnga

SEQ ID NO: 1755 - RNA, 10 nt, Artificial Sequence
  intronic recognition element for splicing modifier (REMS)
  misc_feature (8)..(8): n is a, c, g, or u
gugagugnga

SEQ ID NO: 1756 - RNA, 10 nt, Artificial Sequence
  intronic recognition element for splicing modifier (REMS)
  misc_feature (8)..(8): n is a, c, g, or u
uugagugnga

SEQ ID NO: 1757 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angagugngc

SEQ ID NO: 1758 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagagugngc

SEQ ID NO: 1759 - RNA, 10 nt, Artificial Sequence
  intronic recognition element for splicing modifier (REMS)
  misc_feature (8)..(8): n is a, c, g, or u
aagagugngc

SEQ ID NO: 1760 - RNA, 10 nt, Artificial Sequence
  intronic recognition element for splicing modifier (REMS)
  misc_feature (8)..(8): n is a, c, g, or u
cagagugngc

SEQ ID NO: 1761 - RNA, 10 nt, Artificial Sequence
  intronic recognition element for splicing modifier (REMS)
  misc_feature (8)..(8): n is a, c, g, or u
gagagugngc

SEQ ID NO: 1762 - RNA, 10 nt, Artificial Sequence
  intronic recognition element for splicing modifier (REMS)
  misc_feature (8)..(8): n is a, c, g, or u
uagagugngc

SEQ ID NO: 1763 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngagugngc

SEQ ID NO: 1764 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgagugngc

SEQ ID NO: 1765 - RNA, 10 nt, Artificial Sequence
  intronic recognition element for splicing modifier (REMS)
  misc_feature (8)..(8): n is a, c, g, or u
acgagugngc

SEQ ID NO: 1766 - RNA, 10 nt, Artificial Sequence
  intronic recognition element for splicing modifier (REMS)
  misc_feature (8)..(8): n is a, c, g, or u
ccgagugngc

SEQ ID NO: 1767 - RNA, 10 nt, Artificial Sequence
  intronic recognition element for splicing modifier (REMS)
  misc_feature (8)..(8): n is a, c, g, or u
gcgagugngc

SEQ ID NO: 1768 - RNA, 10 nt, Artificial Sequence
  intronic recognition element for splicing modifier (REMS)
  misc_feature (8)..(8): n is a, c, g, or u
ucgagugngc

SEQ ID NO: 1769 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngagugngc

SEQ ID NO: 1770 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggagugngc

SEQ ID NO: 1771 - RNA, 10 nt, Artificial Sequence
  intronic recognition element for splicing modifier (REMS)
  misc_feature (8)..(8): n is a, c, g, or u
aggagugngc

SEQ ID NO: 1772 - RNA, 10 nt, Artificial Sequence
  intronic recognition element for splicing modifier (REMS)
  misc_feature (8)..(8): n is a, c, g, or u
cggagugngc

SEQ ID NO: 1773 - RNA, 10 nt, Artificial Sequence
  intronic recognition element for splicing modifier (REMS)
  misc_feature (8)..(8): n is a, c, g, or u
gggagugngc

SEQ ID NO: 1774 - RNA, 10 nt, Artificial Sequence
  intronic recognition element for splicing modifier (REMS)
  misc_feature (8)..(8): n is a, c, g, or u
uggagugngc

SEQ ID NO: 1775 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungagugngc

SEQ ID NO: 1776 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugagugngc

SEQ ID NO: 1777 - RNA, 10 nt, Artificial Sequence
  intronic recognition element for splicing modifier (REMS)
  misc_feature (8)..(8): n is a, c, g, or u
augagugngc

SEQ ID NO: 1778 - RNA, 10 nt, Artificial Sequence
  intronic recognition element for splicing modifier (REMS)
  misc_feature (8)..(8): n is a, c, g, or u
cugagugngc

SEQ ID NO: 1779 - RNA, 10 nt, Artificial Sequence
  intronic recognition element for splicing modifier (REMS)
  misc_feature (8)..(8): n is a, c, g, or u
gugagugngc

SEQ ID NO: 1780 - RNA, 10 nt, Artificial Sequence
  intronic recognition element for splicing modifier (REMS)
  misc_feature (8)..(8): n is a, c, g, or u
uugagugngc

SEQ ID NO: 1781 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angagugngg

SEQ ID NO: 1782 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagagugngg

SEQ ID NO: 1783 - RNA, 10 nt, Artificial Sequence
  intronic recognition element for splicing modifier (REMS)
  misc_feature (8)..(8): n is a, c, g, or u
aagagugngg

SEQ ID NO: 1784 - RNA, 10 nt, Artificial Sequence
  intronic recognition element for splicing modifier (REMS)
  misc_feature (8)..(8): n is a, c, g, or u
cagagugngg

SEQ ID NO: 1785 - RNA, 10 nt, Artificial Sequence
  intronic recognition element for splicing modifier (REMS)
  misc_feature (8)..(8): n is a, c, g, or u
gagagugngg

SEQ ID NO: 1786 - RNA, 10 nt, Artificial Sequence
  intronic recognition element for splicing modifier (REMS)
  misc_feature (8)..(8): n is a, c, g, or u
uagagugngg

SEQ ID NO: 1787 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngagugngg

SEQ ID NO: 1788 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgagugngg

SEQ ID NO: 1789 - RNA, 10 nt, Artificial Sequence
  intronic recognition element for splicing modifier (REMS)
  misc_feature (8)..(8): n is a, c, g, or u
acgagugngg

SEQ ID NO: 1790 - RNA, 10 nt, Artificial Sequence
  intronic recognition element for splicing modifier (REMS)
  misc_feature (8)..(8): n is a, c, g, or u
ccgagugngg

SEQ ID NO: 1791 - RNA, 10 nt, Artificial Sequence
  intronic recognition element for splicing modifier (REMS)
  misc_feature (8)..(8): n is a, c, g, or u
gcgagugngg

SEQ ID NO: 1792 - RNA, 10 nt, Artificial Sequence
  intronic recognition element for splicing modifier (REMS)
  misc_feature (8)..(8): n is a, c, g, or u
ucgagugngg

SEQ ID NO: 1793 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngagugngg

SEQ ID NO: 1794 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggagugngg

SEQ ID NO: 1795 - RNA, 10 nt, Artificial Sequence
  intronic recognition element for splicing modifier (REMS)
  misc_feature (8)..(8): n is a, c, g, or u
aggagugngg

SEQ ID NO: 1796 - RNA, 10 nt, Artificial Sequence
  intronic recognition element for splicing modifier (REMS)
  misc_feature (8)..(8): n is a, c, g, or u
cggagugngg

SEQ ID NO: 1797 - RNA, 10 nt, Artificial Sequence
  intronic recognition element for splicing modifier (REMS)
  misc_feature (8)..(8): n is a, c, g, or u
gggagugngg

SEQ ID NO: 1798 - RNA, 10 nt, Artificial Sequence
  intronic recognition element for splicing modifier (REMS)
  misc_feature (8)..(8): n is a, c, g, or u
uggagugngg

SEQ ID NO: 1799 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungagugngg

SEQ ID NO: 1800 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugagugngg

SEQ ID NO: 1801 - RNA, 10 nt, Artificial Sequence
  intronic recognition element for splicing modifier (REMS)
  misc_feature (8)..(8): n is a, c, g, or u
augagugngg

SEQ ID NO: 1802 - RNA, 10 nt, Artificial Sequence
  intronic recognition element for splicing modifier (REMS)
  misc_feature (8)..(8): n is a, c, g, or u
cugagugngg

SEQ ID NO: 1803 - RNA, 10 nt, Artificial Sequence
  intronic recognition element for splicing modifier (REMS)
  misc_feature (8)..(8): n is a, c, g, or u
gugagugngg

SEQ ID NO: 1804 - RNA, 10 nt, Artificial Sequence
  intronic recognition element for splicing modifier (REMS)
  misc_feature (8)..(8): n is a, c, g, or u
uugagugngg

SEQ ID NO: 1805 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
angagugngu

SEQ ID NO: 1806 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nagagugngu

SEQ ID NO: 1807 - RNA, 10 nt, Artificial Sequence
  intronic recognition element for splicing modifier (REMS)
  misc_feature (8)..(8): n is a, c, g, or u
aagagugngu

SEQ ID NO: 1808 - RNA, 10 nt, Artificial Sequence
  intronic recognition element for splicing modifier (REMS)
  misc_feature (8)..(8): n is a, c, g, or u
cagagugngu

SEQ ID NO: 1809 - RNA, 10 nt, Artificial Sequence
  intronic recognition element for splicing modifier (REMS)
  misc_feature (8)..(8): n is a, c, g, or u
gagagugngu

SEQ ID NO: 1810 - RNA, 10 nt, Artificial Sequence
  intronic recognition element for splicing modifier (REMS)
  misc_feature (8)..(8): n is a, c, g, or u
uagagugngu

SEQ ID NO: 1811 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
cngagugngu

SEQ ID NO: 1812 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
ncgagugngu

SEQ ID NO: 1813 - RNA, 10 nt, Artificial Sequence
  intronic recognition element for splicing modifier (REMS)
  misc_feature (8)..(8): n is a, c, g, or u
acgagugngu

SEQ ID NO: 1814 - RNA, 10 nt, Artificial Sequence
  intronic recognition element for splicing modifier (REMS)
  misc_feature (8)..(8): n is a, c, g, or u
ccgagugngu

SEQ ID NO: 1815 - RNA, 10 nt, Artificial Sequence
  intronic recognition element for splicing modifier (REMS)
  misc_feature (8)..(8): n is a, c, g, or u
gcgagugngu

SEQ ID NO: 1816 - RNA, 10 nt, Artificial Sequence
  intronic recognition element for splicing modifier (REMS)
  misc_feature (8)..(8): n is a, c, g, or u
ucgagugngu

SEQ ID NO: 1817 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
gngagugngu

SEQ ID NO: 1818 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nggagugngu

SEQ ID NO: 1819 - RNA, 10 nt, Artificial Sequence
  intronic recognition element for splicing modifier (REMS)
  misc_feature (8)..(8): n is a, c, g, or u
aggagugngu

SEQ ID NO: 1820 - RNA, 10 nt, Artificial Sequence
  intronic recognition element for splicing modifier (REMS)
  misc_feature (8)..(8): n is a, c, g, or u
cggagugngu

SEQ ID NO: 1821 - RNA, 10 nt, Artificial Sequence
  intronic recognition element for splicing modifier (REMS)
  misc_feature (8)..(8): n is a, c, g, or u
gggagugngu

SEQ ID NO: 1822 - RNA, 10 nt, Artificial Sequence
  intronic recognition element for splicing modifier (REMS)
  misc_feature (8)..(8): n is a, c, g, or u
uggagugngu

SEQ ID NO: 1823 - RNA, 10 nt, Artificial Sequence
  intronic recognition element for splicing modifier (REMS)
  misc_feature (2)..(2): n is a, c, g, or u
  misc_feature (8)..(8): n is a, c, g, or u
ungagugngu

SEQ ID NO: 1824 - RNA, 10 nt, Artificial Sequence
  intronic recognition element for splicing modifier (REMS)
  misc_feature (1)..(1): n is a, c, g, or u
  misc_feature (8)..(8): n is a, c, g, or u
nugagugngu

SEQ ID NO: 1825 - RNA, 10 nt, Artificial Sequence
  intronic recognition element for splicing modifier (REMS)
  misc_feature (8)..(8): n is a, c, g, or u
augagugngu

SEQ ID NO: 1826 - RNA, 10 nt, Artificial Sequence
  intronic recognition element for splicing modifier (REMS)
  misc_feature (8)..(8): n is a, c, g, or u
cugagugngu

SEQ ID NO: 1827 - RNA, 10 nt, Artificial Sequence
  intronic recognition element for splicing modifier (REMS)
  misc_feature (8)..(8): n is a, c, g, or u
gugagugngu

SEQ ID NO: 1828 - RNA, 10 nt, Artificial Sequence
  intronic recognition element for splicing modifier (REMS)
  misc_feature (8)..(8): n is a, c, g, or u
uugagugngu

SEQ ID NO: 1829 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
angagtrngn

SEQ ID NO: 1830 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
nagagtrngn

SEQ ID NO: 1831 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
aagagtrngn

SEQ ID NO: 1832 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
cagagtrngn

SEQ ID NO: 1833 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gagagtrngn

SEQ ID NO: 1834 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tagagtrngn

SEQ ID NO: 1835 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
cngagtrngn

SEQ ID NO: 1836 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
ncgagtrngn

SEQ ID NO: 1837 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
acgagtrngn

SEQ ID NO: 1838 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ccgagtrngn

SEQ ID NO: 1839 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gcgagtrngn

SEQ ID NO: 1840 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tcgagtrngn

SEQ ID NO: 1841 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
gngagtrngn

SEQ ID NO: 1842 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
nggagtrngn

SEQ ID NO: 1843 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
aggagtrngn

SEQ ID NO: 1844 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
cggagtrngn

SEQ ID NO: 1845 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gggagtrngn

SEQ ID NO: 1846 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tggagtrngn

SEQ ID NO: 1847 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
tngagtrngn

SEQ ID NO: 1848 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
ntgagtrngn

SEQ ID NO: 1849 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
atgagtrngn

SEQ ID NO: 1850 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ctgagtrngn

SEQ ID NO: 1851 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gtgagtrngn

SEQ ID NO: 1852 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ttgagtrngn

SEQ ID NO: 1853 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtragn

SEQ ID NO: 1854 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtragn

SEQ ID NO: 1855 - DNA, 10 bp, Artificial Sequence
  intronic recognition element for splicing modifier (REMS)
  misc_feature (10)..(10): n is a, c, g, or t
aagagtragn

SEQ ID NO: 1856 - DNA, 10 bp, Artificial Sequence
  intronic recognition element for splicing modifier (REMS)
  misc_feature (10)..(10): n is a, c, g, or t
cagagtragn

SEQ ID NO: 1857 - DNA, 10 bp, Artificial Sequence
  intronic recognition element for splicing modifier (REMS)
  misc_feature (10)..(10): n is a, c, g, or t
gagagtragn

SEQ ID NO: 1858 - DNA, 10 bp, Artificial Sequence
  intronic recognition element for splicing modifier (REMS)
  misc_feature (10)..(10): n is a, c, g, or t
tagagtragn

SEQ ID NO: 1859 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtragn

SEQ ID NO: 1860 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtragn

SEQ ID NO: 1861 - DNA, 10 bp, Artificial Sequence
  intronic recognition element for splicing modifier (REMS)
  misc_feature (10)..(10): n is a, c, g, or t
acgagtragn

SEQ ID NO: 1862 - DNA, 10 bp, Artificial Sequence
  intronic recognition element for splicing modifier (REMS)
  misc_feature (10)..(10): n is a, c, g, or t
ccgagtragn

SEQ ID NO: 1863 - DNA, 10 bp, Artificial Sequence
  intronic recognition element for splicing modifier (REMS)
  misc_feature (10)..(10): n is a, c, g, or t
gcgagtragn

SEQ ID NO: 1864 - DNA, 10 bp, Artificial Sequence
  intronic recognition element for splicing modifier (REMS)
  misc_feature (10)..(10): n is a, c, g, or t
tcgagtragn

SEQ ID NO: 1865 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtragn

SEQ ID NO: 1866 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtragn

SEQ ID NO: 1867 - DNA, 10 bp, Artificial Sequence
  intronic recognition element for splicing modifier (REMS)
  misc_feature (10)..(10): n is a, c, g, or t
aggagtragn

SEQ ID NO: 1868 - DNA, 10 bp, Artificial Sequence
  intronic recognition element for splicing modifier (REMS)
  misc_feature (10)..(10): n is a, c, g, or t
cggagtragn

SEQ ID NO: 1869 - DNA, 10 bp, Artificial Sequence
  intronic recognition element for splicing modifier (REMS)
  misc_feature (10)..(10): n is a, c, g, or t
gggagtragn

SEQ ID NO: 1870 - DNA, 10 bp, Artificial Sequence
  intronic recognition element for splicing modifier (REMS)
  misc_feature (10)..(10): n is a, c, g, or t
tggagtragn

SEQ ID NO: 1871 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtragn

SEQ ID NO: 1872 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtragn

SEQ ID NO: 1873 - DNA, 10 bp, Artificial Sequence
  intronic recognition element for splicing modifier (REMS)
  misc_feature (10)..(10): n is a, c, g, or t
atgagtragn

SEQ ID NO: 1874 - DNA, 10 bp, Artificial Sequence
  intronic recognition element for splicing modifier (REMS)
  misc_feature (10)..(10): n is a, c, g, or t
ctgagtragn

SEQ ID NO: 1875 - DNA, 10 bp, Artificial Sequence
  intronic recognition element for splicing modifier (REMS)
  misc_feature (10)..(10): n is a, c, g, or t
gtgagtragn

SEQ ID NO: 1876 - DNA, 10 bp, Artificial Sequence
  intronic recognition element for splicing modifier (REMS)
  misc_feature (10)..(10): n is a, c, g, or t
ttgagtragn

SEQ ID NO: 1877 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtrcgn

SEQ ID NO: 1878 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtrcgn

SEQ ID NO: 1879 - DNA, 10 bp, Artificial Sequence
  intronic recognition element for splicing modifier (REMS)
  misc_feature (10)..(10): n is a, c, g, or t
aagagtrcgn

SEQ ID NO: 1880 - DNA, 10 bp, Artificial Sequence
  intronic recognition element for splicing modifier (REMS)
  misc_feature (10)..(10): n is a, c, g, or t
cagagtrcgn

SEQ ID NO: 1881 - DNA, 10 bp, Artificial Sequence
  intronic recognition element for splicing modifier (REMS)
  misc_feature (10)..(10): n is a, c, g, or t
gagagtrcgn

SEQ ID NO: 1882 - DNA, 10 bp, Artificial Sequence
  intronic recognition element for splicing modifier (REMS)
  misc_feature (10)..(10): n is a, c, g, or t
tagagtrcgn

SEQ ID NO: 1883 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtrcgn

SEQ ID NO: 1884 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtrcgn

SEQ ID NO: 1885 - DNA, 10 bp, Artificial Sequence
  intronic recognition element for splicing modifier (REMS)
  misc_feature (10)..(10): n is a, c, g, or t
acgagtrcgn

SEQ ID NO: 1886 - DNA, 10 bp, Artificial Sequence
  intronic recognition element for splicing modifier (REMS)
  misc_feature (10)..(10): n is a, c, g, or t
ccgagtrcgn

SEQ ID NO: 1887 - DNA, 10 bp, Artificial Sequence
  intronic recognition element for splicing modifier (REMS)
  misc_feature (10)..(10): n is a, c, g, or t
gcgagtrcgn

SEQ ID NO: 1888 - DNA, 10 bp, Artificial Sequence
  intronic recognition element for splicing modifier (REMS)
  misc_feature (10)..(10): n is a, c, g, or t
tcgagtrcgn

SEQ ID NO: 1889 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtrcgn

SEQ ID NO: 1890 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtrcgn

SEQ ID NO: 1891 - DNA, 10 bp, Artificial Sequence
  intronic recognition element for splicing modifier (REMS)
  misc_feature (10)..(10): n is a, c, g, or t
aggagtrcgn

SEQ ID NO: 1892 - DNA, 10 bp, Artificial Sequence
  intronic recognition element for splicing modifier (REMS)
  misc_feature (10)..(10): n is a, c, g, or t
cggagtrcgn

SEQ ID NO: 1893 - DNA, 10 bp, Artificial Sequence
  intronic recognition element for splicing modifier (REMS)
  misc_feature (10)..(10): n is a, c, g, or t
gggagtrcgn

SEQ ID NO: 1894 - DNA, 10 bp, Artificial Sequence
  intronic recognition element for splicing modifier (REMS)
  misc_feature (10)..(10): n is a, c, g, or t
tggagtrcgn

SEQ ID NO: 1895 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtrcgn

SEQ ID NO: 1896 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtrcgn

SEQ ID NO: 1897 - DNA, 10 bp, Artificial Sequence
  intronic recognition element for splicing modifier (REMS)
  misc_feature (10)..(10): n is a, c, g, or t
atgagtrcgn

SEQ ID NO: 1898 - DNA, 10 bp, Artificial Sequence
  intronic recognition element for splicing modifier (REMS)
  misc_feature (10)..(10): n is a, c, g, or t
ctgagtrcgn

SEQ ID NO: 1899 - DNA, 10 bp, Artificial Sequence
  intronic recognition element for splicing modifier (REMS)
  misc_feature (10)..(10): n is a, c, g, or t
gtgagtrcgn

SEQ ID NO: 1900 - DNA, 10 bp, Artificial Sequence
  intronic recognition element for splicing modifier (REMS)
  misc_feature (10)..(10): n is a, c, g, or t
ttgagtrcgn

SEQ ID NO: 1901 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtrggn

SEQ ID NO: 1902 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtrggn

SEQ ID NO: 1903 - DNA, 10 bp, Artificial Sequence
  intronic recognition element for splicing modifier (REMS)
  misc_feature (10)..(10): n is a, c, g, or t
aagagtrggn

SEQ ID NO: 1904 - DNA, 10 bp, Artificial Sequence
  intronic recognition element for splicing modifier (REMS)
  misc_feature (10)..(10): n is a, c, g, or t
cagagtrggn

SEQ ID NO: 1905 - DNA, 10 bp, Artificial Sequence
  intronic recognition element for splicing modifier (REMS)
  misc_feature (10)..(10): n is a, c, g, or t
gagagtrggn

SEQ ID NO: 1906 - DNA, 10 bp, Artificial Sequence
  intronic recognition element for splicing modifier (REMS)
  misc_feature (10)..(10): n is a, c, g, or t
tagagtrggn

SEQ ID NO: 1907 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtrggn

SEQ ID NO: 1908 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtrggn

SEQ ID NO: 1909 - DNA, 10 bp, Artificial Sequence
  intronic recognition element for splicing modifier (REMS)
  misc_feature (10)..(10): n is a, c, g, or t
acgagtrggn

SEQ ID NO: 1910 - DNA, 10 bp, Artificial Sequence
  intronic recognition element for splicing modifier (REMS)
  misc_feature (10)..(10): n is a, c, g, or t
ccgagtrggn

SEQ ID NO: 1911 - DNA, 10 bp, Artificial Sequence
  intronic recognition element for splicing modifier (REMS)
  misc_feature (10)..(10): n is a, c, g, or t
gcgagtrggn

SEQ ID NO: 1912 - DNA, 10 bp, Artificial Sequence
  intronic recognition element for splicing modifier (REMS)
  misc_feature (10)..(10): n is a, c, g, or t
tcgagtrggn

SEQ ID NO: 1913 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtrggn

SEQ ID NO: 1914 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtrggn

SEQ ID NO: 1915 - DNA, 10 bp, Artificial Sequence
  intronic recognition element for splicing modifier (REMS)
  misc_feature (10)..(10): n is a, c, g, or t
aggagtrggn

SEQ ID NO: 1916 - DNA, 10 bp, Artificial Sequence
  intronic recognition element for splicing modifier (REMS)
  misc_feature (10)..(10): n is a, c, g, or t
cggagtrggn

SEQ ID NO: 1917 - DNA, 10 bp, Artificial Sequence
  intronic recognition element for splicing modifier (REMS)
  misc_feature (10)..(10): n is a, c, g, or t
gggagtrggn

SEQ ID NO: 1918 - DNA, 10 bp, Artificial Sequence
  intronic recognition element for splicing modifier (REMS)
  misc_feature (10)..(10): n is a, c, g, or t
tggagtrggn

SEQ ID NO: 1919 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtrggn

SEQ ID NO: 1920 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtrggn

SEQ ID NO: 1921 - DNA, 10 bp, Artificial Sequence
  intronic recognition element for splicing modifier (REMS)
  misc_feature (10)..(10): n is a, c, g, or t
atgagtrggn

SEQ ID NO: 1922 - DNA, 10 bp, Artificial Sequence
  intronic recognition element for splicing modifier (REMS)
  misc_feature (10)..(10): n is a, c, g, or t
ctgagtrggn

SEQ ID NO: 1923 - DNA, 10 bp, Artificial Sequence
  intronic recognition element for splicing modifier (REMS)
  misc_feature (10)..(10): n is a, c, g, or t
gtgagtrggn

SEQ ID NO: 1924 - DNA, 10 bp, Artificial Sequence
  intronic recognition element for splicing modifier (REMS)
  misc_feature (10)..(10): n is a, c, g, or t
ttgagtrggn

SEQ ID NO: 1925 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtrtgn

SEQ ID NO: 1926 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtrtgn

SEQ ID NO: 1927 - DNA, 10 bp, Artificial Sequence
  intronic recognition element for splicing modifier (REMS)
  misc_feature (10)..(10): n is a, c, g, or t
aagagtrtgn

SEQ ID NO: 1928 - DNA, 10 bp, Artificial Sequence
  intronic recognition element for splicing modifier (REMS)
  misc_feature (10)..(10): n is a, c, g, or t
cagagtrtgn

SEQ ID NO: 1929 - DNA, 10 bp, Artificial Sequence
  intronic recognition element for splicing modifier (REMS)
  misc_feature (10)..(10): n is a, c, g, or t
gagagtrtgn

SEQ ID NO: 1930 - DNA, 10 bp, Artificial Sequence
  intronic recognition element for splicing modifier (REMS)
  misc_feature (10)..(10): n is a, c, g, or t
tagagtrtgn

SEQ ID NO: 1931 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtrtgn

SEQ ID NO: 1932 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtrtgn

SEQ ID NO: 1933 - DNA, 10 bp, Artificial Sequence
  intronic recognition element for splicing modifier (REMS)
  misc_feature (10)..(10): n is a, c, g, or t
acgagtrtgn

SEQ ID NO: 1934 - DNA, 10 bp, Artificial Sequence
  intronic recognition element for splicing modifier (REMS)
  misc_feature (10)..(10): n is a, c, g, or t
ccgagtrtgn

SEQ ID NO: 1935 - DNA, 10 bp, Artificial Sequence
  intronic recognition element for splicing modifier (REMS)
  misc_feature (10)..(10): n is a, c, g, or t
gcgagtrtgn

SEQ ID NO: 1936 - DNA, 10 bp, Artificial Sequence
  intronic recognition element for splicing modifier (REMS)
  misc_feature (10)..(10): n is a, c, g, or t
tcgagtrtgn

SEQ ID NO: 1937 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtrtgn

SEQ ID NO: 1938 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtrtgn

SEQ ID NO: 1939 - DNA, 10 bp, Artificial Sequence
  intronic recognition element for splicing modifier (REMS)
  misc_feature (10)..(10): n is a, c, g, or t
aggagtrtgn

SEQ ID NO: 1940 - DNA, 10 bp, Artificial Sequence
  intronic recognition element for splicing modifier (REMS)
  misc_feature (10)..(10): n is a, c, g, or t
cggagtrtgn

SEQ ID NO: 1941 - DNA, 10 bp, Artificial Sequence
  intronic recognition element for splicing modifier (REMS)
  misc_feature (10)..(10): n is a, c, g, or t
gggagtrtgn

SEQ ID NO: 1942 - DNA, 10 bp, Artificial Sequence
  intronic recognition element for splicing modifier (REMS)
  misc_feature (10)..(10): n is a, c, g, or t
tggagtrtgn

SEQ ID NO: 1943 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtrtgn

SEQ ID NO: 1944 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtrtgn

SEQ ID NO: 1945 - DNA, 10 bp, Artificial Sequence
  intronic recognition element for splicing modifier (REMS)
  misc_feature (10)..(10): n is a, c, g, or t
atgagtrtgn

SEQ ID NO: 1946 - DNA, 10 bp, Artificial Sequence
  intronic recognition element for splicing modifier (REMS)
  misc_feature (10)..(10): n is a, c, g, or t
ctgagtrtgn

SEQ ID NO: 1947 - DNA, 10 bp, Artificial Sequence
  intronic recognition element for splicing modifier (REMS)
  misc_feature (10)..(10): n is a, c, g, or t
gtgagtrtgn

SEQ ID NO: 1948 - DNA, 10 bp, Artificial Sequence
  intronic recognition element for splicing modifier (REMS)
  misc_feature (10)..(10): n is a, c, g, or t
ttgagtrtgn

SEQ ID NO: 1949 - DNA, 10 bp, Artificial Sequence
  intronic recognition element for splicing modifier (REMS)
  misc_feature (2)..(2): n is a, c, g, or t
angagtraga

SEQ ID NO: 1950 - DNA, 10 bp, Artificial Sequence
  intronic recognition element for splicing modifier (REMS)
  misc_feature (1)..(1): n is a, c, g, or t
nagagtraga

SEQ ID NO: 1951 - DNA, 10 bp, Artificial Sequence
  intronic recognition element for splicing modifier (REMS)
aagagtraga

SEQ ID NO: 1952 - DNA, 10 bp, Artificial Sequence
  intronic recognition element for splicing modifier (REMS)
cagagtraga

SEQ ID NO: 1953 - DNA, 10 bp, Artificial Sequence
  intronic recognition element for splicing modifier (REMS)
gagagtraga

SEQ ID NO: 1954 - DNA, 10 bp, Artificial Sequence
  intronic recognition element for splicing modifier (REMS)
tagagtraga

SEQ ID NO: 1955 - DNA, 10 bp, Artificial Sequence
  intronic recognition element for splicing modifier (REMS)
  misc_feature (2)..(2): n is a, c, g, or t
cngagtraga

SEQ ID NO: 1956 - DNA, 10 bp, Artificial Sequence
  intronic recognition element for splicing modifier (REMS)
  misc_feature (1)..(1): n is a, c, g, or t
ncgagtraga

SEQ ID NO: 1957 - DNA, 10 bp, Artificial Sequence
  intronic recognition element for splicing modifier (REMS)
acgagtraga

SEQ ID NO: 1958 - DNA, 10 bp, Artificial Sequence
  intronic recognition element for splicing modifier (REMS)
ccgagtraga

SEQ ID NO: 1959 - DNA, 10 bp, Artificial Sequence
  intronic recognition element for splicing modifier (REMS)
gcgagtraga

SEQ ID NO: 1960 - DNA, 10 bp, Artificial Sequence
  intronic recognition element for splicing modifier (REMS)
tcgagtraga

SEQ ID NO: 1961 - DNA, 10 bp, Artificial Sequence
  intronic recognition element for splicing modifier (REMS)
  misc_feature (2)..(2): n is a, c, g, or t
gngagtraga

SEQ ID NO: 1962 - DNA, 10 bp, Artificial Sequence
  intronic recognition element for splicing modifier (REMS)
  misc_feature (1)..(1): n is a, c, g, or t
nggagtraga

SEQ ID NO: 1963 - DNA, 10 bp, Artificial Sequence
  intronic recognition element for splicing modifier (REMS)
aggagtraga

SEQ ID NO: 1964 - DNA, 10 bp, Artificial Sequence
  intronic recognition element for splicing modifier (REMS)
cggagtraga

SEQ ID NO: 1965 - DNA, 10 bp, Artificial Sequence
  intronic recognition element for splicing modifier (REMS)
gggagtraga

SEQ ID NO: 1966 - DNA, 10 bp, Artificial Sequence
  intronic recognition element for splicing modifier (REMS)
tggagtraga

SEQ ID NO: 1967 - DNA, 10 bp, Artificial Sequence
  intronic recognition element for splicing modifier (REMS)
  misc_feature (2)..(2): n is a, c, g, or t
tngagtraga

SEQ ID NO: 1968 - DNA, 10 bp, Artificial Sequence
  intronic recognition element for splicing modifier (REMS)
  misc_feature (1)..(1): n is a, c, g, or t
ntgagtraga

SEQ ID NO: 1969 - DNA, 10 bp, Artificial Sequence
  intronic recognition element for splicing modifier (REMS)
atgagtraga

SEQ ID NO: 1970 - DNA, 10 bp, Artificial Sequence
  intronic recognition element for splicing modifier (REMS)
ctgagtraga

SEQ ID NO: 1971 - DNA, 10 bp, Artificial Sequence
  intronic recognition element for splicing modifier (REMS)
gtgagtraga

SEQ ID NO: 1972 - DNA, 10 bp, Artificial Sequence
  intronic recognition element for splicing modifier (REMS)
ttgagtraga

SEQ ID NO: 1973 - DNA, 10 bp, Artificial Sequence
  intronic recognition element for splicing modifier (REMS)
  misc_feature (2)..(2): n is a, c, g, or t
angagtrcga

SEQ ID NO: 1974 - DNA, 10 bp, Artificial Sequence
  intronic recognition element for splicing modifier (REMS)
  misc_feature (1)..(1): n is a, c, g, or t
nagagtrcga

SEQ ID NO: 1975 - DNA, 10 bp, Artificial Sequence
  intronic recognition element for splicing modifier (REMS)
aagagtrcga

SEQ ID NO: 1976 - DNA, 10 bp, Artificial Sequence
  intronic recognition element for splicing modifier (REMS)
cagagtrcga

SEQ ID NO: 1977 - DNA, 10 bp, Artificial Sequence
  intronic recognition element for splicing modifier (REMS)
gagagtrcga

SEQ ID NO: 1978 - DNA, 10 bp, Artificial Sequence
  intronic recognition element for splicing modifier (REMS)
tagagtrcga

SEQ ID NO: 1979 - DNA, 10 bp, Artificial Sequence
  intronic recognition element for splicing modifier (REMS)
  misc_feature (2)..(2): n is a, c, g, or t
cngagtrcga

SEQ ID NO: 1980 - DNA, 10 bp, Artificial Sequence
  intronic recognition element for splicing modifier (REMS)
  misc_feature (1)..(1): n is a, c, g, or t
ncgagtrcga

SEQ ID NO: 1981 - DNA, 10 bp, Artificial Sequence
  intronic recognition element for splicing modifier (REMS)
acgagtrcga

SEQ ID NO: 1982 - DNA, 10 bp, Artificial Sequence
  intronic recognition element for splicing modifier (REMS)
ccgagtrcga

SEQ ID NO: 1983 - DNA, 10 bp, Artificial Sequence
  intronic recognition element for splicing modifier (REMS)
gcgagtrcga

SEQ ID NO: 1984 - DNA, 10 bp, Artificial Sequence
  intronic recognition element for splicing modifier (REMS)
tcgagtrcga

SEQ ID NO: 1985 - DNA, 10 bp, Artificial Sequence
  intronic recognition element for splicing modifier (REMS)
  misc_feature (2)..(2): n is a, c, g, or t
gngagtrcga

SEQ ID NO: 1986 - DNA, 10 bp, Artificial Sequence
  intronic recognition element for splicing modifier (REMS)
  misc_feature (1)..(1): n is a, c, g, or t
nggagtrcga

SEQ ID NO: 1987 - DNA, 10 bp, Artificial Sequence
  intronic recognition element for splicing modifier (REMS)
aggagtrcga

SEQ ID NO: 1988 - DNA, 10 bp, Artificial Sequence
  intronic recognition element for splicing modifier (REMS)
cggagtrcga

SEQ ID NO: 1989 - DNA, 10 bp, Artificial Sequence
  intronic recognition element for splicing modifier (REMS)
gggagtrcga

SEQ ID NO: 1990 - DNA, 10 bp, Artificial Sequence
  intronic recognition element for splicing modifier (REMS)
tggagtrcga

SEQ ID NO: 1991 - DNA, 10 bp, Artificial Sequence
  intronic recognition element for splicing modifier (REMS)
  misc_feature (2)..(2): n is a, c, g, or t
tngagtrcga

SEQ ID NO: 1992 - DNA, 10 bp, Artificial Sequence
  intronic recognition element for splicing modifier (REMS)
  misc_feature (1)..(1): n is a, c, g, or t
ntgagtrcga

SEQ ID NO: 1993 - DNA, 10 bp, Artificial Sequence
  intronic recognition element for splicing modifier (REMS)
atgagtrcga

SEQ ID NO: 1994 - DNA, 10 bp, Artificial Sequence
  intronic recognition element for splicing modifier (REMS)
ctgagtrcga

SEQ ID NO: 1995 - DNA, 10 bp, Artificial Sequence
  intronic recognition element for splicing modifier (REMS)
gtgagtrcga

SEQ ID NO: 1996 - DNA, 10 bp, Artificial Sequence
  intronic recognition element for splicing modifier (REMS)
ttgagtrcga

SEQ ID NO: 1997 - DNA, 10 bp, Artificial Sequence
  intronic recognition element for splicing modifier (REMS)
  misc_feature (2)..(2): n is a, c, g, or t
angagtrgga

SEQ ID NO: 1998 - DNA, 10 bp, Artificial Sequence
  intronic recognition element for splicing modifier (REMS)
  misc_feature (1)..(1): n is a, c, g, or t
nagagtrgga

SEQ ID NO: 1999 - DNA, 10 bp, Artificial Sequence
  intronic recognition element for splicing modifier (REMS)
aagagtrgga

SEQ ID NO: 2000 - DNA, 10 bp, Artificial Sequence
  intronic recognition element for splicing modifier (REMS)
cagagtrgga

SEQ ID NO: 2001 - DNA, 10 bp, Artificial Sequence
  intronic recognition element for splicing modifier (REMS)
gagagtrgga

SEQ ID NO: 2002 - DNA, 10 bp, Artificial Sequence
  intronic recognition element for splicing modifier (REMS)
tagagtrgga

SEQ ID NO: 2003 - DNA, 10 bp, Artificial Sequence
  intronic recognition element for splicing modifier (REMS)
  misc_feature (2)..(2): n is a, c, g, or t
cngagtrgga

SEQ ID NO: 2004 - DNA, 10 bp, Artificial Sequence
  intronic recognition element for splicing modifier (REMS)
  misc_feature (1)..(1): n is a, c, g, or t
ncgagtrgga

SEQ ID NO: 2005 - DNA, 10 bp, Artificial Sequence
  intronic recognition element for splicing modifier (REMS)
acgagtrgga

SEQ ID NO: 2006 - DNA, 10 bp, Artificial Sequence
  intronic recognition element for splicing modifier (REMS)
ccgagtrgga

SEQ ID NO: 2007 - DNA, 10 bp, Artificial Sequence
  intronic recognition element for splicing modifier (REMS)
gcgagtrgga

SEQ ID NO: 2008 - DNA, 10 bp, Artificial Sequence
  intronic recognition element for splicing modifier (REMS)
tcgagtrgga

SEQ ID NO: 2009 - DNA, 10 bp, Artificial Sequence
  intronic recognition element for splicing modifier (REMS)
  misc_feature (2)..(2): n is a, c, g, or t
gngagtrgga

SEQ ID NO: 2010 - DNA, 10 bp, Artificial Sequence
  intronic recognition element for splicing modifier (REMS)
  misc_feature (1)..(1): n is a, c, g, or t
nggagtrgga

SEQ ID NO: 2011 - DNA, 10 bp, Artificial Sequence
  intronic recognition element for splicing modifier (REMS)
aggagtrgga

SEQ ID NO: 2012 - DNA, 10 bp, Artificial Sequence
  intronic recognition element for splicing modifier (REMS)
cggagtrgga

SEQ ID NO: 2013 - DNA, 10 bp, Artificial Sequence
  intronic recognition element for splicing modifier (REMS)
gggagtrgga

SEQ ID NO: 2014 - DNA, 10 bp, Artificial Sequence
  intronic recognition element for splicing modifier (REMS)
tggagtrgga

SEQ ID NO: 2015 - DNA, 10 bp, Artificial Sequence
  intronic recognition element for splicing modifier (REMS)
  misc_feature (2)..(2): n is a, c, g, or t
tngagtrgga

SEQ ID NO: 2016 - DNA, 10 bp, Artificial Sequence
  intronic recognition element for splicing modifier (REMS)
  misc_feature (1)..(1): n is a, c, g, or t
ntgagtrgga

SEQ ID NO: 2017 - DNA, 10 bp, Artificial Sequence
  intronic recognition element for splicing modifier (REMS)
atgagtrgga

SEQ ID NO: 2018 - DNA, 10 bp, Artificial Sequence
  intronic recognition element for splicing modifier (REMS)
ctgagtrgga

SEQ ID NO: 2019 - DNA, 10 bp, Artificial Sequence
  intronic recognition element for splicing modifier (REMS)
gtgagtrgga

SEQ ID NO: 2020 - DNA, 10 bp, Artificial Sequence
  intronic recognition element for splicing modifier (REMS)
ttgagtrgga

SEQ ID NO: 2021 - DNA, 10 bp, Artificial Sequence
  intronic recognition element for splicing modifier (REMS)
  misc_feature (2)..(2): n is a, c, g, or t
angagtrtga

SEQ ID NO: 2022 - DNA, 10 bp, Artificial Sequence
  intronic recognition element for splicing modifier (REMS)
  misc_feature (1)..(1): n is a, c, g, or t
nagagtrtga

SEQ ID NO: 2023 - DNA, 10 bp, Artificial Sequence
  intronic recognition element for splicing modifier (REMS)
aagagtrtga

SEQ ID NO: 2024 - DNA, 10 bp, Artificial Sequence
  intronic recognition element for splicing modifier (REMS)
cagagtrtga

SEQ ID NO: 2025 - DNA, 10 bp, Artificial Sequence
  intronic recognition element for splicing modifier (REMS)
gagagtrtga

SEQ ID NO: 2026 - DNA, 10 bp, Artificial Sequence
  intronic recognition element for splicing modifier (REMS)
tagagtrtga

SEQ ID NO: 2027 - DNA, 10 bp, Artificial Sequence
  intronic recognition element for splicing modifier (REMS)
  misc_feature (2)..(2): n is a, c, g, or t
cngagtrtga

SEQ ID NO: 2028 - DNA, 10 bp, Artificial Sequence
  intronic recognition element for splicing modifier (REMS)
  misc_feature (1)..(1): n is a, c, g, or t
ncgagtrtga

SEQ ID NO: 2029 - DNA, 10 bp, Artificial Sequence
  intronic recognition element for splicing modifier (REMS)
acgagtrtga

SEQ ID NO: 2030 - DNA, 10 bp, Artificial Sequence
  intronic recognition element for splicing modifier (REMS)
ccgagtrtga

SEQ ID NO: 2031 - DNA, 10 bp, Artificial Sequence
  intronic recognition element for splicing modifier (REMS)
gcgagtrtga

SEQ ID NO: 2032 - DNA, 10 bp, Artificial Sequence
  intronic recognition element for splicing modifier (REMS)
tcgagtrtga

SEQ ID NO: 2033 - DNA, 10 bp, Artificial Sequence
  intronic recognition element for splicing modifier (REMS)
  misc_feature (2)..(2): n is a, c, g, or t
gngagtrtga

SEQ ID NO: 2034 - DNA, 10 bp, Artificial Sequence
  intronic recognition element for splicing modifier (REMS)
  misc_feature (1)..(1): n is a, c, g, or t
nggagtrtga

SEQ ID NO: 2035 - DNA, 10 bp, Artificial Sequence
  intronic recognition element for splicing modifier (REMS)
aggagtrtga

SEQ ID NO: 2036 - DNA, 10 bp, Artificial Sequence
  intronic recognition element for splicing modifier (REMS)
cggagtrtga

SEQ ID NO: 2037 - DNA, 10 bp, Artificial Sequence
  intronic recognition element for splicing modifier (REMS)
gggagtrtga

SEQ ID NO: 2038 - DNA, 10 bp, Artificial Sequence
  intronic recognition element for splicing modifier (REMS)
tggagtrtga

SEQ ID NO: 2039 - DNA, 10 bp, Artificial Sequence
  intronic recognition element for splicing modifier (REMS)
  misc_feature (2)..(2): n is a, c, g, or t
tngagtrtga

SEQ ID NO: 2040 - DNA, 10 bp, Artificial Sequence
  intronic recognition element for splicing modifier (REMS)
  misc_feature (1)..(1): n is a, c, g, or t
ntgagtrtga

SEQ ID NO: 2041 - DNA, 10 bp, Artificial Sequence
  intronic recognition element for splicing modifier (REMS)
atgagtrtga

SEQ ID NO: 2042 - DNA, 10 bp, Artificial Sequence
  intronic recognition element for splicing modifier (REMS)
ctgagtrtga

SEQ ID NO: 2043 - DNA, 10 bp, Artificial Sequence
  intronic recognition element for splicing modifier (REMS)
gtgagtrtga

SEQ ID NO: 2044 - DNA, 10 bp, Artificial Sequence
  intronic recognition element for splicing modifier (REMS)
ttgagtrtga

SEQ ID NO: 2045 - DNA, 10 bp, Artificial Sequence
  intronic recognition element for splicing modifier (REMS)
  misc_feature (2)..(2): n is a, c, g, or t
angagtragc

SEQ ID NO: 2046 - DNA, 10 bp, Artificial Sequence
  intronic recognition element for splicing modifier (REMS)
  misc_feature (1)..(1): n is a, c, g, or t
nagagtragc

SEQ ID NO: 2047 - DNA, 10 bp, Artificial Sequence
  intronic recognition element for splicing modifier (REMS)
aagagtragc

SEQ ID NO: 2048 - DNA, 10 bp, Artificial Sequence
  intronic recognition element for splicing modifier (REMS)
cagagtragc

SEQ ID NO: 2049 - DNA, 10 bp, Artificial Sequence
  intronic recognition element for splicing modifier (REMS)
gagagtragc

SEQ ID NO: 2050 - DNA, 10 bp, Artificial Sequence
  intronic recognition element for splicing modifier (REMS)
tagagtragc

SEQ ID NO: 2051 - DNA, 10 bp, Artificial Sequence
  intronic recognition element for splicing modifier (REMS)
  misc_feature (2)..(2): n is a, c, g, or t
cngagtragc

SEQ ID NO: 2052 - DNA, 10 bp, Artificial Sequence
  intronic recognition element for splicing modifier (REMS)
  misc_feature (1)..(1): n is a, c, g, or t
ncgagtragc

SEQ ID NO: 2053 - DNA, 10 bp, Artificial Sequence
  intronic recognition element for splicing modifier (REMS)
acgagtragc

SEQ ID NO: 2054 - DNA, 10 bp, Artificial Sequence
  intronic recognition element for splicing modifier (REMS)
ccgagtragc

SEQ ID NO: 2055 - DNA, 10 bp, Artificial Sequence
  intronic recognition element for splicing modifier (REMS)
gcgagtragc

SEQ ID NO: 2056 - DNA, 10 bp, Artificial Sequence
  intronic recognition element for splicing modifier (REMS)
tcgagtragc

SEQ ID NO: 2057 - DNA, 10 bp, Artificial Sequence
  intronic recognition element for splicing modifier (REMS)
  misc_feature (2)..(2): n is a, c, g, or t
gngagtragc

SEQ ID NO: 2058 - DNA, 10 bp, Artificial Sequence
  intronic recognition element for splicing modifier (REMS)
  misc_feature (1)..(1): n is a, c, g, or t
nggagtragc

SEQ ID NO: 2059 - DNA, 10 bp, Artificial Sequence
  intronic recognition element for splicing modifier (REMS)
aggagtragc

SEQ ID NO: 2060 - DNA, 10 bp, Artificial Sequence
  intronic recognition element for splicing modifier (REMS)
cggagtragc

SEQ ID NO: 2061 - DNA, 10 bp, Artificial Sequence
  intronic recognition element for splicing modifier (REMS)
gggagtragc

SEQ ID NO: 2062 - DNA, 10 bp, Artificial Sequence
  intronic recognition element for splicing modifier (REMS)
tggagtragc

SEQ ID NO: 2063 - DNA, 10 bp, Artificial Sequence
  intronic recognition element for splicing modifier (REMS)
  misc_feature (2)..(2): n is a, c, g, or t
tngagtragc

SEQ ID NO: 2064 - DNA, 10 bp, Artificial Sequence
  intronic recognition element for splicing modifier (REMS)
  misc_feature (1)..(1): n is a, c, g, or t
ntgagtragc

SEQ ID NO: 2065 - DNA, 10 bp, Artificial Sequence
  intronic recognition element for splicing modifier (REMS)
atgagtragc

SEQ ID NO: 2066 - DNA, 10 bp, Artificial Sequence
  intronic recognition element for splicing modifier (REMS)
ctgagtragc

SEQ ID NO: 2067 - DNA, 10 bp, Artificial Sequence
  intronic recognition element for splicing modifier (REMS)
gtgagtragc

SEQ ID NO: 2068 - DNA, 10 bp, Artificial Sequence
  intronic recognition element for splicing modifier (REMS)
ttgagtragc

SEQ ID NO: 2069 - DNA, 10 bp, Artificial Sequence
  intronic recognition element for splicing modifier (REMS)
  misc_feature (2)..(2): n is a, c, g, or t
angagtrcgc

SEQ ID NO: 2070 - DNA, 10 bp, Artificial Sequence
  intronic recognition element for splicing modifier (REMS)
  misc_feature (1)..(1): n is a, c, g, or t
nagagtrcgc

SEQ ID NO: 2071 - DNA, 10 bp, Artificial Sequence
  intronic recognition element for splicing modifier (REMS)
aagagtrcgc

SEQ ID NO: 2072 - DNA, 10 bp, Artificial Sequence
  intronic recognition element for splicing modifier (REMS)
cagagtrcgc

SEQ ID NO: 2073 - DNA, 10 bp, Artificial Sequence
  intronic recognition element for splicing modifier (REMS)
gagagtrcgc

SEQ ID NO: 2074 - DNA, 10 bp, Artificial Sequence
  intronic recognition element for splicing modifier (REMS)
tagagtrcgc

SEQ ID NO: 2075 - DNA, 10 bp, Artificial Sequence
  intronic recognition element for splicing modifier (REMS)
  misc_feature (2)..(2): n is a, c, g, or t
cngagtrcgc

SEQ ID NO: 2076 - DNA, 10 bp, Artificial Sequence
  intronic recognition element for splicing modifier (REMS)
  misc_feature (1)..(1): n is a, c, g, or t
ncgagtrcgc

SEQ ID NO: 2077 - DNA, 10 bp, Artificial Sequence
  intronic recognition element for splicing modifier (REMS)
acgagtrcgc

SEQ ID NO: 2078 - DNA, 10 bp, Artificial Sequence
  intronic recognition element for splicing modifier (REMS)
ccgagtrcgc

SEQ ID NO: 2079 - DNA, 10 bp, Artificial Sequence
  intronic recognition element for splicing modifier (REMS)
gcgagtrcgc

SEQ ID NO: 2080 - DNA, 10 bp, Artificial Sequence
  intronic recognition element for splicing modifier (REMS)
tcgagtrcgc

SEQ ID NO: 2081 - DNA, 10 bp, Artificial Sequence
  intronic recognition element for splicing modifier (REMS)
  misc_feature (2)..(2): n is a, c, g, or t
gngagtrcgc

SEQ ID NO: 2082 - DNA, 10 bp, Artificial Sequence
  intronic recognition element for splicing modifier (REMS)
  misc_feature (1)..(1): n is a, c, g, or t
nggagtrcgc

SEQ ID NO: 2083 - DNA, 10 bp, Artificial Sequence
  intronic recognition element for splicing modifier (REMS)
aggagtrcgc

SEQ ID NO: 2084 - DNA, 10 bp, Artificial Sequence
  intronic recognition element for splicing modifier (REMS)
cggagtrcgc

SEQ ID NO: 2085 - DNA, 10 bp, Artificial Sequence
  intronic recognition element for splicing modifier (REMS)
gggagtrcgc

SEQ ID NO: 2086 - DNA, 10 bp, Artificial Sequence
  intronic recognition element for splicing modifier (REMS)
tggagtrcgc

SEQ ID NO: 2087 - DNA, 10 bp, Artificial Sequence
  intronic recognition element for splicing modifier (REMS)
  misc_feature (2)..(2): n is a, c, g, or t
tngagtrcgc

SEQ ID NO: 2088 - DNA, 10 bp, Artificial Sequence
  intronic recognition element for splicing modifier (REMS)
  misc_feature (1)..(1): n is a, c, g, or t
ntgagtrcgc

SEQ ID NO: 2089 - DNA, 10 bp, Artificial Sequence
  intronic recognition element for splicing modifier (REMS)
atgagtrcgc

SEQ ID NO: 2090 - DNA, 10 bp, Artificial Sequence
  intronic recognition element for splicing modifier (REMS)
ctgagtrcgc

SEQ ID NO: 2091 - DNA, 10 bp, Artificial Sequence
  intronic recognition element for splicing modifier (REMS)
gtgagtrcgc

SEQ ID NO: 2092 - DNA, 10 bp, Artificial Sequence
  intronic recognition element for splicing modifier (REMS)
ttgagtrcgc

SEQ ID NO: 2093 - DNA, 10 bp, Artificial Sequence
  intronic recognition element for splicing modifier (REMS)
  misc_feature (2)..(2): n is a, c, g, or t
angagtrggc

SEQ ID NO: 2094 - DNA, 10 bp, Artificial Sequence
  intronic recognition element for splicing modifier (REMS)
  misc_feature (1)..(1): n is a, c, g, or t
nagagtrggc

SEQ ID NO: 2095 - DNA, 10 bp, Artificial Sequence
  intronic recognition element for splicing modifier (REMS)
aagagtrggc

SEQ ID NO: 2096 - DNA, 10 bp, Artificial Sequence
  intronic recognition element for splicing modifier (REMS)
cagagtrggc

SEQ ID NO: 2097 - DNA, 10 bp, Artificial Sequence
  intronic recognition element for splicing modifier (REMS)
gagagtrggc

SEQ ID NO: 2098 - DNA, 10 bp, Artificial Sequence
  intronic recognition element for splicing modifier (REMS)
tagagtrggc

SEQ ID NO: 2099 - DNA, 10 bp, Artificial Sequence
  intronic recognition element for splicing modifier (REMS)
  misc_feature (2)..(2): n is a, c, g, or t
cngagtrggc

SEQ ID NO: 2100 - DNA, 10 bp, Artificial Sequence
  intronic recognition element for splicing modifier (REMS)
  misc_feature (1)..(1): n is a, c, g, or t
ncgagtrggc

SEQ ID NO: 2101 - DNA, 10 bp, Artificial Sequence
  intronic recognition element for splicing modifier (REMS)
acgagtrggc

SEQ ID NO: 2102 - DNA, 10 bp, Artificial Sequence
  intronic recognition element for splicing modifier (REMS)
ccgagtrggc

SEQ ID NO: 2103 - DNA, 10 bp, Artificial Sequence
  intronic recognition element for splicing modifier (REMS)
gcgagtrggc

SEQ ID NO: 2104 - DNA, 10 bp, Artificial Sequence
  intronic recognition element for splicing modifier (REMS)
tcgagtrggc

SEQ ID NO: 2105 - DNA, 10 bp, Artificial Sequence
  intronic recognition element for splicing modifier (REMS)
  misc_feature (2)..(2): n is a, c, g, or t
gngagtrggc

SEQ ID NO: 2106 - DNA, 10 bp, Artificial Sequence
  intronic recognition element for splicing modifier (REMS)
  misc_feature (1)..(1): n is a, c, g, or t
nggagtrggc

SEQ ID NO: 2107 - DNA, 10 bp, Artificial Sequence
  intronic recognition element for splicing modifier (REMS)
aggagtrggc

SEQ ID NO: 2108 - DNA, 10 bp, Artificial Sequence
  intronic recognition element for splicing modifier (REMS)
cggagtrggc

SEQ ID NO: 2109 - DNA, 10 bp, Artificial Sequence
  intronic recognition element for splicing modifier (REMS)
gggagtrggc

SEQ ID NO: 2110 - DNA, 10 bp, Artificial Sequence
  intronic recognition element for splicing modifier (REMS)
tggagtrggc

SEQ ID NO: 2111 - DNA, 10 bp, Artificial Sequence
  intronic recognition element for splicing modifier (REMS)
  misc_feature (2)..(2): n is a, c, g, or t
tngagtrggc

SEQ ID NO: 2112 - DNA, 10 bp, Artificial Sequence
  intronic recognition element for splicing modifier (REMS)
  misc_feature (1)..(1): n is a, c, g, or t
ntgagtrggc

SEQ ID NO: 2113 - DNA, 10 bp, Artificial Sequence
  intronic recognition element for splicing modifier (REMS)
atgagtrggc

SEQ ID NO: 2114 - DNA, 10 bp, Artificial Sequence
  intronic recognition element for splicing modifier (REMS)
ctgagtrggc

SEQ ID NO: 2115 - DNA, 10 bp, Artificial Sequence
  intronic recognition element for splicing modifier (REMS)
gtgagtrggc

SEQ ID NO: 2116 - DNA, 10 bp, Artificial Sequence
  intronic recognition element for splicing modifier (REMS)
ttgagtrggc

SEQ ID NO: 2117 - DNA, 10 bp, Artificial Sequence
  intronic recognition element for splicing modifier (REMS)
  misc_feature (2)..(2): n is a, c, g, or t
angagtrtgc

SEQ ID NO: 2118 - DNA, 10 bp, Artificial Sequence
  intronic recognition element for splicing modifier (REMS)
  misc_feature (1)..(1): n is a, c, g, or t
nagagtrtgc

SEQ ID NO: 2119 - DNA, 10 bp, Artificial Sequence
  intronic recognition element for splicing modifier (REMS)
aagagtrtgc

SEQ ID NO: 2120 - DNA, 10 bp, Artificial Sequence
  intronic recognition element for splicing modifier (REMS)
cagagtrtgc

SEQ ID NO: 2121 - DNA, 10 bp, Artificial Sequence
  intronic recognition element for splicing modifier (REMS)
gagagtrtgc

SEQ ID NO: 2122 - DNA, 10 bp, Artificial Sequence
  intronic recognition element for splicing modifier (REMS)
tagagtrtgc

SEQ ID NO: 2123 - DNA, 10 bp, Artificial Sequence
  intronic recognition element for splicing modifier (REMS)
  misc_feature (2)..(2): n is a, c, g, or t
cngagtrtgc

SEQ ID NO: 2124 - DNA, 10 bp, Artificial Sequence
  intronic recognition element for splicing modifier (REMS)
  misc_feature (1)..(1): n is a, c, g, or t
ncgagtrtgc

SEQ ID NO: 2125 - DNA, 10 bp, Artificial Sequence
  intronic recognition element for splicing modifier (REMS)
acgagtrtgc

SEQ ID NO: 2126 - DNA, 10 bp, Artificial Sequence
  intronic recognition element for splicing modifier (REMS)
ccgagtrtgc

SEQ ID NO: 2127 - DNA, 10 bp, Artificial Sequence
  intronic recognition element for splicing modifier (REMS)
gcgagtrtgc

SEQ ID NO: 2128 - DNA, 10 bp, Artificial Sequence
  intronic recognition element for splicing modifier (REMS)
tcgagtrtgc

SEQ ID NO: 2129 - DNA, 10 bp, Artificial Sequence
  intronic recognition element for splicing modifier (REMS)
  misc_feature (2)..(2): n is a, c, g, or t
gngagtrtgc

SEQ ID NO: 2130 - DNA, 10 bp, Artificial Sequence
  intronic recognition element for splicing modifier (REMS)
  misc_feature (1)..(1): n is a, c, g, or t
nggagtrtgc

SEQ ID NO: 2131 - DNA, 10 bp, Artificial Sequence
  intronic recognition element for splicing modifier (REMS)
aggagtrtgc

SEQ ID NO: 2132 - DNA, 10 bp, Artificial Sequence
  intronic recognition element for splicing modifier (REMS)
cggagtrtgc

SEQ ID NO: 2133 - DNA, 10 bp, Artificial Sequence
  intronic recognition element for splicing modifier (REMS)
gggagtrtgc

SEQ ID NO: 2134 - DNA, 10 bp, Artificial Sequence
  intronic recognition element for splicing modifier (REMS)
tggagtrtgc

SEQ ID NO: 2135 - DNA, 10 bp, Artificial Sequence
  intronic recognition element for splicing modifier (REMS)
  misc_feature (2)..(2): n is a, c, g, or t
tngagtrtgc

SEQ ID NO: 2136 - DNA, 10 bp, Artificial Sequence
  intronic recognition element for splicing modifier (REMS)
  misc_feature (1)..(1): n is a, c, g, or t
ntgagtrtgc

SEQ ID NO: 2137 - DNA, 10 bp, Artificial Sequence
  intronic recognition element for splicing modifier (REMS)
atgagtrtgc

SEQ ID NO: 2138 - DNA, 10 bp, Artificial Sequence
  intronic recognition element for splicing modifier (REMS)
ctgagtrtgc

SEQ ID NO: 2139 - DNA, 10 bp, Artificial Sequence
  intronic recognition element for splicing modifier (REMS)
gtgagtrtgc

SEQ ID NO: 2140 - DNA, 10 bp, Artificial Sequence
  intronic recognition element for splicing modifier (REMS)
ttgagtrtgc

SEQ ID NO: 2141 - DNA, 10 bp, Artificial Sequence
  intronic recognition element for splicing modifier (REMS)
  misc_feature (2)..(2): n is a, c, g, or t
angagtragg

SEQ ID NO: 2142 - DNA, 10 bp, Artificial Sequence
  intronic recognition element for splicing modifier (REMS)
  misc_feature (1)..(1): n is a, c, g, or t
nagagtragg

SEQ ID NO: 2143 - DNA, 10 bp, Artificial Sequence
  intronic recognition element for splicing modifier (REMS)
aagagtragg

SEQ ID NO: 2144 - DNA, 10 bp, Artificial Sequence
  intronic recognition element for splicing modifier (REMS)
cagagtragg

SEQ ID NO: 2145 - DNA, 10 bp, Artificial Sequence
  intronic recognition element for splicing modifier (REMS)
gagagtragg

SEQ ID NO: 2146 - DNA, 10 bp, Artificial Sequence
  intronic recognition element for splicing modifier (REMS)
tagagtragg

SEQ ID NO: 2147 - DNA, 10 bp, Artificial Sequence
  intronic recognition element for splicing modifier (REMS)
  misc_feature (2)..(2): n is a, c, g, or t
cngagtragg

SEQ ID NO: 2148 - DNA, 10 bp, Artificial Sequence
  intronic recognition element for splicing modifier (REMS)
  misc_feature (1)..(1): n is a, c, g, or t
ncgagtragg

SEQ ID NO: 2149 - DNA, 10 bp, Artificial Sequence
  intronic recognition element for splicing modifier (REMS)
acgagtragg

SEQ ID NO: 2150 - DNA, 10 bp, Artificial Sequence
  intronic recognition element for splicing modifier (REMS)
ccgagtragg

SEQ ID NO: 2151 - DNA, 10 bp, Artificial Sequence
  intronic recognition element for splicing modifier (REMS)
gcgagtragg

SEQ ID NO: 2152 - DNA, 10 bp, Artificial Sequence
  intronic recognition element for splicing modifier (REMS)
tcgagtragg

SEQ ID NO: 2153 - DNA, 10 bp, Artificial Sequence
  intronic recognition element for splicing modifier (REMS)
  misc_feature (2)..(2): n is a, c, g, or t
gngagtragg

SEQ ID NO: 2154 - DNA, 10 bp, Artificial Sequence
  intronic recognition element for splicing modifier (REMS)
  misc_feature (1)..(1): n is a, c, g, or t
nggagtragg

SEQ ID NO: 2155 - DNA, 10 bp, Artificial Sequence
  intronic recognition element for splicing modifier (REMS)
aggagtragg

SEQ ID NO: 2156 - DNA, 10 bp, Artificial Sequence
  intronic recognition element for splicing modifier (REMS)
cggagtragg

SEQ ID NO: 2157 - DNA, 10 bp, Artificial Sequence
  intronic recognition element for splicing modifier (REMS)
gggagtragg

SEQ ID NO: 2158 - DNA, 10 bp, Artificial Sequence
  intronic recognition element for splicing modifier (REMS)
tggagtragg

SEQ ID NO: 2159 - DNA, 10 bp, Artificial Sequence
  intronic recognition element for splicing modifier (REMS)
  misc_feature (2)..(2): n is a, c, g, or t
tngagtragg

SEQ ID NO: 2160 - DNA, 10 bp, Artificial Sequence
  intronic recognition element for splicing modifier (REMS)
  misc_feature (1)..(1): n is a, c, g, or t
ntgagtragg

SEQ ID NO: 2161 - DNA, 10 bp, Artificial Sequence
  intronic recognition element for splicing modifier (REMS)
atgagtragg

SEQ ID NO: 2162 - DNA, 10 bp, Artificial Sequence
  intronic recognition element for splicing modifier (REMS)
ctgagtragg

SEQ ID NO: 2163 - DNA, 10 bp, Artificial Sequence
  intronic recognition element for splicing modifier (REMS)
gtgagtragg

SEQ ID NO: 2164 - DNA, 10 bp, Artificial Sequence
  intronic recognition element for splicing modifier (REMS)
ttgagtragg

SEQ ID NO: 2165 - DNA, 10 bp, Artificial Sequence
  intronic recognition element for splicing modifier (REMS)
  misc_feature (2)..(2): n is a, c, g, or t
angagtrcgg

SEQ ID NO: 2166 - DNA, 10 bp, Artificial Sequence
  intronic recognition element for splicing modifier (REMS)
  misc_feature (1)..(1): n is a, c, g, or t
nagagtrcgg

SEQ ID NO: 2167 - DNA, 10 bp, Artificial Sequence
  intronic recognition element for splicing modifier (REMS)
aagagtrcgg

SEQ ID NO: 2168 - DNA, 10 bp, Artificial Sequence
  intronic recognition element for splicing modifier (REMS)
cagagtrcgg

SEQ ID NO: 2169 - DNA, 10 bp, Artificial Sequence
  intronic recognition element for splicing modifier (REMS)
gagagtrcgg

SEQ ID NO: 2170 - DNA, 10 bp, Artificial Sequence
  intronic recognition element for splicing modifier (REMS)
tagagtrcgg

SEQ ID NO: 2171 - DNA, 10 bp, Artificial Sequence
  intronic recognition element for splicing modifier (REMS)
  misc_feature (2)..(2): n is a, c, g, or t
cngagtrcgg

SEQ ID NO: 2172 - DNA, 10 bp, Artificial Sequence
  intronic recognition element for splicing modifier (REMS)
  misc_feature (1)..(1): n is a, c, g, or t
ncgagtrcgg

SEQ ID NO: 2173 - DNA, 10 bp, Artificial Sequence
  intronic recognition element for splicing modifier (REMS)
acgagtrcgg

SEQ ID NO: 2174 - DNA, 10 bp, Artificial Sequence
  intronic recognition element for splicing modifier (REMS)
ccgagtrcgg

SEQ ID NO: 2175 - DNA, 10 bp, Artificial Sequence
  intronic recognition element for splicing modifier (REMS)
gcgagtrcgg

SEQ ID NO: 2176 - DNA, 10 bp, Artificial Sequence
  intronic recognition element for splicing modifier (REMS)
tcgagtrcgg

SEQ ID NO: 2177 - DNA, 10 bp, Artificial Sequence
  intronic recognition element for splicing modifier (REMS)
  misc_feature (2)..(2): n is a, c, g, or t
gngagtrcgg

SEQ ID NO: 2178 - DNA, 10 bp, Artificial Sequence
  intronic recognition element for splicing modifier (REMS)
  misc_feature (1)..(1): n is a, c, g, or t
nggagtrcgg

SEQ ID NO: 2179 - DNA, 10 bp, Artificial Sequence
  intronic recognition element for splicing modifier (REMS)
aggagtrcgg

SEQ ID NO: 2180 - DNA, 10 bp, Artificial Sequence
  intronic recognition element for splicing modifier (REMS)
cggagtrcgg

SEQ ID NO: 2181 - DNA, 10 bp, Artificial Sequence
  intronic recognition element for splicing modifier (REMS)
gggagtrcgg

SEQ ID NO: 2182 - DNA, 10 bp, Artificial Sequence
  intronic recognition element for splicing modifier (REMS)
tggagtrcgg

SEQ ID NO: 2183 - DNA, 10 bp, Artificial Sequence
  intronic recognition element for splicing modifier (REMS)
  misc_feature (2)..(2): n is a, c, g, or t
tngagtrcgg

SEQ ID NO: 2184 - DNA, 10 bp, Artificial Sequence
  intronic recognition element for splicing modifier (REMS)
  misc_feature (1)..(1): n is a, c, g, or t
ntgagtrcgg

SEQ ID NO: 2185 - DNA, 10 bp, Artificial Sequence
  intronic recognition element for splicing modifier (REMS)
atgagtrcgg

SEQ ID NO: 2186 - DNA, 10 bp, Artificial Sequence
  intronic recognition element for splicing modifier (REMS)
ctgagtrcgg

SEQ ID NO: 2187 - DNA, 10 bp, Artificial Sequence
  intronic recognition element for splicing modifier (REMS)
gtgagtrcgg

SEQ ID NO: 2188 - DNA, 10 bp, Artificial Sequence
  intronic recognition element for splicing modifier (REMS)
ttgagtrcgg

SEQ ID NO: 2189 - DNA, 10 bp, Artificial Sequence
  intronic recognition element for splicing modifier (REMS)
  misc_feature (2)..(2): n is a, c, g, or t
angagtrggg

SEQ ID NO: 2190 - DNA, 10 bp, Artificial Sequence
  intronic recognition element for splicing modifier (REMS)
  misc_feature (1)..(1): n is a, c, g, or t
nagagtrggg

SEQ ID NO: 2191 - DNA, 10 bp, Artificial Sequence
  intronic recognition element for splicing modifier (REMS)
aagagtrggg

SEQ ID NO: 2192 - DNA, 10 bp, Artificial Sequence
  intronic recognition element for splicing modifier (REMS)
cagagtrggg

SEQ ID NO: 2193 - DNA, 10 bp, Artificial Sequence
  intronic recognition element for splicing modifier (REMS)
gagagtrggg

SEQ ID NO: 2194 - DNA, 10 bp, Artificial Sequence
  intronic recognition element for splicing modifier (REMS)
tagagtrggg

SEQ ID NO: 2195 - DNA, 10 bp, Artificial Sequence
  intronic recognition element for splicing modifier (REMS)
  misc_feature (2)..(2): n is a, c, g, or t
cngagtrggg

SEQ ID NO: 2196 - DNA, 10 bp, Artificial Sequence
  intronic recognition element for splicing modifier (REMS)
  misc_feature (1)..(1): n is a, c, g, or t
ncgagtrggg

SEQ ID NO: 2197 - DNA, 10 bp, Artificial Sequence
  intronic recognition element for splicing modifier (REMS)
acgagtrggg

SEQ ID NO: 2198 - DNA, 10 bp, Artificial Sequence
  intronic recognition element for splicing modifier (REMS)
ccgagtrggg

SEQ ID NO: 2199 - DNA, 10 bp, Artificial Sequence
  intronic recognition element for splicing modifier (REMS)
gcgagtrggg

SEQ ID NO: 2200 - DNA, 10 bp, Artificial Sequence
  intronic recognition element for splicing modifier (REMS)
tcgagtrggg

SEQ ID NO: 2201 - DNA, 10 bp, Artificial Sequence
  intronic recognition element for splicing modifier (REMS)
  misc_feature (2)..(2): n is a, c, g, or t
gngagtrggg

SEQ ID NO: 2202 - DNA, 10 bp, Artificial Sequence
  intronic recognition element for splicing modifier (REMS)
  misc_feature (1)..(1): n is a, c, g, or t
nggagtrggg

SEQ ID NO: 2203 - DNA, 10 bp, Artificial Sequence
  intronic recognition element for splicing modifier (REMS)
aggagtrggg

SEQ ID NO: 2204 - DNA, 10 bp, Artificial Sequence
  intronic recognition element for splicing modifier (REMS)
cggagtrggg

SEQ ID NO: 2205 - DNA, 10 bp, Artificial Sequence
  intronic recognition element for splicing modifier (REMS)
gggagtrggg

SEQ ID NO: 2206 - DNA, 10 bp, Artificial Sequence
  intronic recognition element for splicing modifier (REMS)
tggagtrggg

SEQ ID NO: 2207 - DNA, 10 bp, Artificial Sequence
  intronic recognition element for splicing modifier (REMS)
  misc_feature (2)..(2): n is a, c, g, or t
tngagtrggg

SEQ ID NO: 2208 - DNA, 10 bp, Artificial Sequence
  intronic recognition element for splicing modifier (REMS)
  misc_feature (1)..(1): n is a, c, g, or t
ntgagtrggg

SEQ ID NO: 2209 - DNA, 10 bp, Artificial Sequence
  intronic recognition element for splicing modifier (REMS)
atgagtrggg

SEQ ID NO: 2210 - DNA, 10 bp, Artificial Sequence
  intronic recognition element for splicing modifier (REMS)
ctgagtrggg

SEQ ID NO: 2211 - DNA, 10 bp, Artificial Sequence
  intronic recognition element for splicing modifier (REMS)
gtgagtrggg

SEQ ID NO: 2212 - DNA, 10 bp, Artificial Sequence
  intronic recognition element for splicing modifier (REMS)
ttgagtrggg

SEQ ID NO: 2213 - DNA, 10 bp, Artificial Sequence
  intronic recognition element for splicing modifier (REMS)
  misc_feature (2)..(2): n is a, c, g, or t
angagtrtgg

SEQ ID NO: 2214 - DNA, 10 bp, Artificial Sequence
  intronic recognition element for splicing modifier (REMS)
  misc_feature (1)..(1): n is a, c, g, or t
nagagtrtgg

SEQ ID NO: 2215 - DNA, 10 bp, Artificial Sequence
  intronic recognition element for splicing modifier (REMS)
aagagtrtgg

SEQ ID NO: 2216 - DNA, 10 bp, Artificial Sequence
  intronic recognition element for splicing modifier (REMS)
cagagtrtgg

SEQ ID NO: 2217 - DNA, 10 bp, Artificial Sequence
  intronic recognition element for splicing modifier (REMS)
gagagtrtgg

SEQ ID NO: 2218 - DNA, 10 bp, Artificial Sequence
  intronic recognition element for splicing modifier (REMS)
tagagtrtgg

SEQ ID NO: 2219 - DNA, 10 bp, Artificial Sequence
  intronic recognition element for splicing modifier (REMS)
  misc_feature (2)..(2): n is a, c, g, or t
cngagtrtgg

SEQ ID NO: 2220 - DNA, 10 bp, Artificial Sequence
  intronic recognition element for splicing modifier (REMS)
  misc_feature (1)..(1): n is a, c, g, or t
ncgagtrtgg

SEQ ID NO: 2221 - DNA, 10 bp, Artificial Sequence
  intronic recognition element for splicing modifier (REMS)
acgagtrtgg

SEQ ID NO: 2222 - DNA, 10 bp, Artificial Sequence
  intronic recognition element for splicing modifier (REMS)
ccgagtrtgg

SEQ ID NO: 2223 - DNA, 10 bp, Artificial Sequence
  intronic recognition element for splicing modifier (REMS)
gcgagtrtgg

SEQ ID NO: 2224 - DNA, 10 bp, Artificial Sequence
  intronic recognition element for splicing modifier (REMS)
tcgagtrtgg

SEQ ID NO: 2225 - DNA, 10 bp, Artificial Sequence
  intronic recognition element for splicing modifier (REMS)
  misc_feature (2)..(2): n is a, c, g, or t
gngagtrtgg

SEQ ID NO: 2226 - DNA, 10 bp, Artificial Sequence
  intronic recognition element for splicing modifier (REMS)
  misc_feature (1)..(1): n is a, c, g, or t
nggagtrtgg

SEQ ID NO: 2227 - DNA, 10 bp, Artificial Sequence
  intronic recognition element for splicing modifier (REMS)
aggagtrtgg

SEQ ID NO: 2228 - DNA, 10 bp, Artificial Sequence
  intronic recognition element for splicing modifier (REMS)
cggagtrtgg

SEQ ID NO: 2229 - DNA, 10 bp, Artificial Sequence
  intronic recognition element for splicing modifier (REMS)
gggagtrtgg

SEQ ID NO: 2230 - DNA, 10 bp, Artificial Sequence
  intronic recognition element for splicing modifier (REMS)
tggagtrtgg

SEQ ID NO: 2231 - DNA, 10 bp, Artificial Sequence
  intronic recognition element for splicing modifier (REMS)
  misc_feature (2)..(2): n is a, c, g, or t
tngagtrtgg

SEQ ID NO: 2232 - DNA, 10 bp, Artificial Sequence
  intronic recognition element for splicing modifier (REMS)
  misc_feature (1)..(1): n is a, c, g, or t
ntgagtrtgg

SEQ ID NO: 2233 - DNA, 10 bp, Artificial Sequence
  intronic recognition element for splicing modifier (REMS)
atgagtrtgg

SEQ ID NO: 2234 - DNA, 10 bp, Artificial Sequence
  intronic recognition element for splicing modifier (REMS)
ctgagtrtgg

SEQ ID NO: 2235 - DNA, 10 bp, Artificial Sequence
  intronic recognition element for splicing modifier (REMS)
gtgagtrtgg

SEQ ID NO: 2236 - DNA, 10 bp, Artificial Sequence
  intronic recognition element for splicing modifier (REMS)
ttgagtrtgg

SEQ ID NO: 2237 - DNA, 10 bp, Artificial Sequence
  intronic recognition element for splicing modifier (REMS)
  misc_feature (2)..(2): n is a, c, g, or t
angagtragt

SEQ ID NO: 2238 - DNA, 10 bp, Artificial Sequence
  intronic recognition element for splicing modifier (REMS)
  misc_feature (1)..(1): n is a, c, g, or t
nagagtragt

SEQ ID NO: 2239 - DNA, 10 bp, Artificial Sequence
  intronic recognition element for splicing modifier (REMS)
aagagtragt

SEQ ID NO: 2240 - DNA, 10 bp, Artificial Sequence
  intronic recognition element for splicing modifier (REMS)
cagagtragt

SEQ ID NO: 2241 - DNA, 10 bp, Artificial Sequence
  intronic recognition element for splicing modifier (REMS)
gagagtragt

SEQ ID NO: 2242 - DNA, 10 bp, Artificial Sequence
  intronic recognition element for splicing modifier (REMS)
tagagtragt

SEQ ID NO: 2243 - DNA, 10 bp, Artificial Sequence
  intronic recognition element for splicing modifier (REMS)
  misc_feature (2)..(2): n is a, c, g, or t
cngagtragt

SEQ ID NO: 2244 - DNA, 10 bp, Artificial Sequence
  intronic recognition element for splicing modifier (REMS)
  misc_feature (1)..(1): n is a, c, g, or t
ncgagtragt

SEQ ID NO: 2245 - DNA, 10 bp, Artificial Sequence
  intronic recognition element for splicing modifier (REMS)
acgagtragt

SEQ ID NO: 2246 - DNA, 10 bp, Artificial Sequence
  intronic recognition element for splicing modifier (REMS)
ccgagtragt

SEQ ID NO: 2247 - DNA, 10 bp, Artificial Sequence
  intronic recognition element for splicing modifier (REMS)
gcgagtragt

SEQ ID NO: 2248 - DNA, 10 bp, Artificial Sequence
  intronic recognition element for splicing modifier (REMS)
tcgagtragt

SEQ ID NO: 2249 - DNA, 10 bp, Artificial Sequence
  intronic recognition element for splicing modifier (REMS)
  misc_feature (2)..(2): n is a, c, g, or t
gngagtragt

SEQ ID NO: 2250 - DNA, 10 bp, Artificial Sequence
  intronic recognition element for splicing modifier (REMS)
  misc_feature (1)..(1): n is a, c, g, or t
nggagtragt

SEQ ID NO: 2251 - DNA, 10 bp, Artificial Sequence
  intronic recognition element for splicing modifier (REMS)
aggagtragt

SEQ ID NO: 2252 - DNA, 10 bp, Artificial Sequence
  intronic recognition element for splicing modifier (REMS)
cggagtragt

SEQ ID NO: 2253 - DNA, 10 bp, Artificial Sequence
  intronic recognition element for splicing modifier (REMS)
gggagtragt

SEQ ID NO: 2254 - DNA, 10 bp, Artificial Sequence
  intronic recognition element for splicing modifier (REMS)
tggagtragt

SEQ ID NO: 2255 - DNA, 10 bp, Artificial Sequence
  intronic recognition element for splicing modifier (REMS)
  misc_feature (2)..(2): n is a, c, g, or t
tngagtragt

SEQ ID NO: 2256 - DNA, 10 bp, Artificial Sequence
  intronic recognition element for splicing modifier (REMS)
  misc_feature (1)..(1): n is a, c, g, or t
ntgagtragt

SEQ ID NO: 2257 - DNA, 10 bp, Artificial Sequence
  intronic recognition element for splicing modifier (REMS)
atgagtragt

SEQ ID NO: 2258 - DNA, 10 bp, Artificial Sequence
  intronic recognition element for splicing modifier (REMS)
ctgagtragt

SEQ ID NO: 2259 - DNA, 10 bp, Artificial Sequence
  intronic recognition element for splicing modifier (REMS)
gtgagtragt

SEQ ID NO: 2260 - DNA, 10 bp, Artificial Sequence
  intronic recognition element for splicing modifier (REMS)
ttgagtragt

SEQ ID NO: 2261 - DNA, 10 bp, Artificial Sequence
  intronic recognition element for splicing modifier (REMS)
  misc_feature (2)..(2): n is a, c, g, or t
angagtrcgt

SEQ ID NO: 2262 - DNA, 10 bp, Artificial Sequence
  intronic recognition element for splicing modifier (REMS)
  misc_feature (1)..(1): n is a, c, g, or t
nagagtrcgt

SEQ ID NO: 2263 - DNA, 10 bp, Artificial Sequence
  intronic recognition element for splicing modifier (REMS)
aagagtrcgt

SEQ ID NO: 2264 - DNA, 10 bp, Artificial Sequence
  intronic recognition element for splicing modifier (REMS)
cagagtrcgt

SEQ ID NO: 2265 - DNA, 10 bp, Artificial Sequence
  intronic recognition element for splicing modifier (REMS)
gagagtrcgt

SEQ ID NO: 2266 - DNA, 10 bp, Artificial Sequence
  intronic recognition element for splicing modifier (REMS)
tagagtrcgt

SEQ ID NO: 2267 - DNA, 10 bp, Artificial Sequence
  intronic recognition element for splicing modifier (REMS)
  misc_feature (2)..(2): n is a, c, g, or t
cngagtrcgt

SEQ ID NO: 2268 - DNA, 10 bp, Artificial Sequence
  intronic recognition element for splicing modifier (REMS)
  misc_feature (1)..(1): n is a, c, g, or t
ncgagtrcgt

SEQ ID NO: 2269 - DNA, 10 bp, Artificial Sequence
  intronic recognition element for splicing modifier (REMS)
acgagtrcgt

SEQ ID NO: 2270 - DNA, 10 bp, Artificial Sequence
  intronic recognition element for splicing modifier (REMS)
ccgagtrcgt

SEQ ID NO: 2271 - DNA, 10 bp, Artificial Sequence
  intronic recognition element for splicing modifier (REMS)
gcgagtrcgt

SEQ ID NO: 2272 - DNA, 10 bp, Artificial Sequence
  intronic recognition element for splicing modifier (REMS)
tcgagtrcgt

SEQ ID NO: 2273 - DNA, 10 bp, Artificial Sequence
  intronic recognition element for splicing modifier (REMS)
  misc_feature (2)..(2): n is a, c, g, or t
gngagtrcgt

SEQ ID NO: 2274 - DNA, 10 bp, Artificial Sequence
  intronic recognition element for splicing modifier (REMS)
  misc_feature (1)..(1): n is a, c, g, or t
nggagtrcgt

SEQ ID NO: 2275 - DNA, 10 bp, Artificial Sequence
  intronic recognition element for splicing modifier (REMS)
aggagtrcgt

SEQ ID NO: 2276 - DNA, 10 bp, Artificial Sequence
  intronic recognition element for splicing modifier (REMS)
cggagtrcgt

SEQ ID NO: 2277 - DNA, 10 bp, Artificial Sequence
  intronic recognition element for splicing modifier (REMS)
gggagtrcgt

SEQ ID NO: 2278 - DNA, 10 bp, Artificial Sequence
  intronic recognition element for splicing modifier (REMS)
tggagtrcgt

SEQ ID NO: 2279 - DNA, 10 bp, Artificial Sequence
  intronic recognition element for splicing modifier (REMS)
  misc_feature (2)..(2): n is a, c, g, or t
tngagtrcgt

SEQ ID NO: 2280 - DNA, 10 bp, Artificial Sequence
  intronic recognition element for splicing modifier (REMS)
  misc_feature (1)..(1): n is a, c, g, or t
ntgagtrcgt

SEQ ID NO: 2281 - DNA, 10 bp, Artificial Sequence
  intronic recognition element for splicing modifier (REMS)
atgagtrcgt

SEQ ID NO: 2282 - DNA, 10 bp, Artificial Sequence
  intronic recognition element for splicing modifier (REMS)
ctgagtrcgt

SEQ ID NO: 2283 - DNA, 10 bp, Artificial Sequence
  intronic recognition element for splicing modifier (REMS)
gtgagtrcgt

SEQ ID NO: 2284 - DNA, 10 bp, Artificial Sequence
  intronic recognition element for splicing modifier (REMS)
ttgagtrcgt

SEQ ID NO: 2285 - DNA, 10 bp, Artificial Sequence
  intronic recognition element for splicing modifier (REMS)
  misc_feature (2)..(2): n is a, c, g, or t
angagtrggt

SEQ ID NO: 2286 - DNA, 10 bp, Artificial Sequence
  intronic recognition element for splicing modifier (REMS)
  misc_feature (1)..(1): n is a, c, g, or t
nagagtrggt

SEQ ID NO: 2287 - DNA, 10 bp, Artificial Sequence
  intronic recognition element for splicing modifier (REMS)
aagagtrggt

SEQ ID NO: 2288 - DNA, 10 bp, Artificial Sequence
  intronic recognition element for splicing modifier (REMS)
cagagtrggt

SEQ ID NO: 2289 - DNA, 10 bp, Artificial Sequence
  intronic recognition element for splicing modifier (REMS)
gagagtrggt

SEQ ID NO: 2290 - DNA, 10 bp, Artificial Sequence
  intronic recognition element for splicing modifier (REMS)
tagagtrggt

SEQ ID NO: 2291 - DNA, 10 bp, Artificial Sequence
  intronic recognition element for splicing modifier (REMS)
  misc_feature (2)..(2): n is a, c, g, or t
cngagtrggt

SEQ ID NO: 2292 - DNA, 10 bp, Artificial Sequence
  intronic recognition element for splicing modifier (REMS)
  misc_feature (1)..(1): n is a, c, g, or t
ncgagtrggt

SEQ ID NO: 2293 - DNA, 10 bp, Artificial Sequence
  intronic recognition element for splicing modifier (REMS)
acgagtrggt

SEQ ID NO: 2294 - DNA, 10 bp, Artificial Sequence
  intronic recognition element for splicing modifier (REMS)
ccgagtrggt

SEQ ID NO: 2295 - DNA, 10 bp, Artificial Sequence
  intronic recognition element for splicing modifier (REMS)
gcgagtrggt

SEQ ID NO: 2296 - DNA, 10 bp, Artificial Sequence
  intronic recognition element for splicing modifier (REMS)
tcgagtrggt

SEQ ID NO: 2297 - DNA, 10 bp, Artificial Sequence
  intronic recognition element for splicing modifier (REMS)
  misc_feature (2)..(2): n is a, c, g, or t
gngagtrggt

SEQ ID NO: 2298 - DNA, 10 bp, Artificial Sequence
  intronic recognition element for splicing modifier (REMS)
  misc_feature (1)..(1): n is a, c, g, or t
nggagtrggt

SEQ ID NO: 2299 - DNA, 10 bp, Artificial Sequence
  intronic recognition element for splicing modifier (REMS)
aggagtrggt

SEQ ID NO: 2300 - DNA, 10 bp, Artificial Sequence
  intronic recognition element for splicing modifier (REMS)
cggagtrggt

SEQ ID NO: 2301 - DNA, 10 bp, Artificial Sequence
  intronic recognition element for splicing modifier (REMS)
gggagtrggt

SEQ ID NO: 2302 - DNA, 10 bp, Artificial Sequence
  intronic recognition element for splicing modifier (REMS)
tggagtrggt

SEQ ID NO: 2303 - DNA, 10 bp, Artificial Sequence
  intronic recognition element for splicing modifier (REMS)
  misc_feature (2)..(2): n is a, c, g, or t
tngagtrggt

SEQ ID NO: 2304 - DNA, 10 bp, Artificial Sequence
  intronic recognition element for splicing modifier (REMS)
  misc_feature (1)..(1): n is a, c, g, or t
ntgagtrggt

SEQ ID NO: 2305 - DNA, 10 bp, Artificial Sequence
  intronic recognition element for splicing modifier (REMS)
atgagtrggt

SEQ ID NO: 2306 - DNA, 10 bp, Artificial Sequence
  intronic recognition element for splicing modifier (REMS)
ctgagtrggt

SEQ ID NO: 2307 - DNA, 10 bp, Artificial Sequence
  intronic recognition element for splicing modifier (REMS)
gtgagtrggt

SEQ ID NO: 2308 - DNA, 10 bp, Artificial Sequence
  intronic recognition element for splicing modifier (REMS)
ttgagtrggt

SEQ ID NO: 2309 - DNA, 10 bp, Artificial Sequence
  intronic recognition element for splicing modifier (REMS)
  misc_feature (2)..(2): n is a, c, g, or t
angagtrtgt

SEQ ID NO: 2310 - DNA, 10 bp, Artificial Sequence
  intronic recognition element for splicing modifier (REMS)
  misc_feature (1)..(1): n is a, c, g, or t
nagagtrtgt

SEQ ID NO: 2311 - DNA, 10 bp, Artificial Sequence
  intronic recognition element for splicing modifier (REMS)
aagagtrtgt

SEQ ID NO: 2312 - DNA, 10 bp, Artificial Sequence
  intronic recognition element for splicing modifier (REMS)
cagagtrtgt

SEQ ID NO: 2313 - DNA, 10 bp, Artificial Sequence
  intronic recognition element for splicing modifier (REMS)
gagagtrtgt

SEQ ID NO: 2314 - DNA, 10 bp, Artificial Sequence
  intronic recognition element for splicing modifier (REMS)
tagagtrtgt

SEQ ID NO: 2315 - DNA, 10 bp, Artificial Sequence
  intronic recognition element for splicing modifier (REMS)
  misc_feature (2)..(2): n is a, c, g, or t
cngagtrtgt

SEQ ID NO: 2316 - DNA, 10 bp, Artificial Sequence
  intronic recognition element for splicing modifier (REMS)
  misc_feature (1)..(1): n is a, c, g, or t
ncgagtrtgt

SEQ ID NO: 2317 - DNA, 10 bp, Artificial Sequence
  intronic recognition element for splicing modifier (REMS)
acgagtrtgt

SEQ ID NO: 2318 - DNA, 10 bp, Artificial Sequence
  intronic recognition element for splicing modifier (REMS)
ccgagtrtgt

SEQ ID NO: 2319 - DNA, 10 bp, Artificial Sequence
  intronic recognition element for splicing modifier (REMS)
gcgagtrtgt

SEQ ID NO: 2320 - DNA, 10 bp, Artificial Sequence
  intronic recognition element for splicing modifier (REMS)
tcgagtrtgt

SEQ ID NO: 2321 - DNA, 10 bp, Artificial Sequence
  intronic recognition element for splicing modifier (REMS)
  misc_feature (2)..(2): n is a, c, g, or t
gngagtrtgt

SEQ ID NO: 2322 - DNA, 10 bp, Artificial Sequence
  intronic recognition element for splicing modifier (REMS)
  misc_feature (1)..(1): n is a, c, g, or t
nggagtrtgt

SEQ ID NO: 2323 - DNA, 10 bp, Artificial Sequence
  intronic recognition element for splicing modifier (REMS)
aggagtrtgt

SEQ ID NO: 2324 - DNA, 10 bp, Artificial Sequence
  intronic recognition element for splicing modifier (REMS)
cggagtrtgt

SEQ ID NO: 2325 - DNA, 10 bp, Artificial Sequence
  intronic recognition element for splicing modifier (REMS)
gggagtrtgt

SEQ ID NO: 2326 - DNA, 10 bp, Artificial Sequence
  intronic recognition element for splicing modifier (REMS)
tggagtrtgt

SEQ ID NO: 2327 - DNA, 10 bp, Artificial Sequence
  intronic recognition element for splicing modifier (REMS)
  misc_feature (2)..(2): n is a, c, g, or t
tngagtrtgt

SEQ ID NO: 2328 - DNA, 10 bp, Artificial Sequence
  intronic recognition element for splicing modifier (REMS)
  misc_feature (1)..(1): n is a, c, g, or t
ntgagtrtgt

SEQ ID NO: 2329 - DNA, 10 bp, Artificial Sequence
  intronic recognition element for splicing modifier (REMS)
atgagtrtgt

SEQ ID NO: 2330 - DNA, 10 bp, Artificial Sequence
  intronic recognition element for splicing modifier (REMS)
ctgagtrtgt

SEQ ID NO: 2331 - DNA, 10 bp, Artificial Sequence
  intronic recognition element for splicing modifier (REMS)
gtgagtrtgt

SEQ ID NO: 2332 - DNA, 10 bp, Artificial Sequence
  intronic recognition element for splicing modifier (REMS)
ttgagtrtgt

SEQ ID NO: 2333 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtrnga

SEQ ID NO: 2334 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtrnga

SEQ ID NO: 2335 - DNA, 10 bp, Artificial Sequence
  intronic recognition element for splicing modifier (REMS)
  misc_feature (8)..(8): n is a, c, g, or t
aagagtrnga

SEQ ID NO: 2336 - DNA, 10 bp, Artificial Sequence
  intronic recognition element for splicing modifier (REMS)
  misc_feature (8)..(8): n is a, c, g, or t
cagagtrnga

SEQ ID NO: 2337 - DNA, 10 bp, Artificial Sequence
  intronic recognition element for splicing modifier (REMS)
  misc_feature (8)..(8): n is a, c, g, or t
gagagtrnga

SEQ ID NO: 2338 - DNA, 10 bp, Artificial Sequence
  intronic recognition element for splicing modifier (REMS)
  misc_feature (8)..(8): n is a, c, g, or t
tagagtrnga

SEQ ID NO: 2339 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtrnga

SEQ ID NO: 2340 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtrnga

SEQ ID NO: 2341 - DNA, 10 bp, Artificial Sequence
  intronic recognition element for splicing modifier (REMS)
  misc_feature (8)..(8): n is a, c, g, or t
acgagtrnga

SEQ ID NO: 2342 - DNA, 10 bp, Artificial Sequence
  intronic recognition element for splicing modifier (REMS)
  misc_feature (8)..(8): n is a, c, g, or t
ccgagtrnga

SEQ ID NO: 2343 - DNA, 10 bp, Artificial Sequence
  intronic recognition element for splicing modifier (REMS)
  misc_feature (8)..(8): n is a, c, g, or t
gcgagtrnga

SEQ ID NO: 2344 - DNA, 10 bp, Artificial Sequence
  intronic recognition element for splicing modifier (REMS)
  misc_feature (8)..(8): n is a, c, g, or t
tcgagtrnga

SEQ ID NO: 2345 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtrnga

SEQ ID NO: 2346 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtrnga

SEQ ID NO: 2347 - DNA, 10 bp, Artificial Sequence
  intronic recognition element for splicing modifier (REMS)
  misc_feature (8)..(8): n is a, c, g, or t
aggagtrnga

SEQ ID NO: 2348 - DNA, 10 bp, Artificial Sequence
  intronic recognition element for splicing modifier (REMS)
  misc_feature (8)..(8): n is a, c, g, or t
cggagtrnga

SEQ ID NO: 2349 - DNA, 10 bp, Artificial Sequence
  intronic recognition element for splicing modifier (REMS)
  misc_feature (8)..(8): n is a, c, g, or t
gggagtrnga

SEQ ID NO: 2350 - DNA, 10 bp, Artificial Sequence
  intronic recognition element for splicing modifier (REMS)
  misc_feature (8)..(8): n is a, c, g, or t
tggagtrnga

SEQ ID NO: 2351 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtrnga

SEQ ID NO: 2352 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtrnga

SEQ ID NO: 2353 - DNA, 10 bp, Artificial Sequence
  intronic recognition element for splicing modifier (REMS)
  misc_feature (8)..(8): n is a, c, g, or t
atgagtrnga

SEQ ID NO: 2354 - DNA, 10 bp, Artificial Sequence
  intronic recognition element for splicing modifier (REMS)
  misc_feature (8)..(8): n is a, c, g, or t
ctgagtrnga

SEQ ID NO: 2355 - DNA, 10 bp, Artificial Sequence
  intronic recognition element for splicing modifier (REMS)
  misc_feature (8)..(8): n is a, c, g, or t
gtgagtrnga

SEQ ID NO: 2356 - DNA, 10 bp, Artificial Sequence
  intronic recognition element for splicing modifier (REMS)
  misc_feature (8)..(8): n is a, c, g, or t
ttgagtrnga

SEQ ID NO: 2357 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtrngc

SEQ ID NO: 2358 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtrngc

SEQ ID NO: 2359 - DNA, 10 bp, Artificial Sequence
  intronic recognition element for splicing modifier (REMS)
  misc_feature (8)..(8): n is a, c, g, or t
aagagtrngc

SEQ ID NO: 2360 - DNA, 10 bp, Artificial Sequence
  intronic recognition element for splicing modifier (REMS)
  misc_feature (8)..(8): n is a, c, g, or t
cagagtrngc

SEQ ID NO: 2361 - DNA, 10 bp, Artificial Sequence
  intronic recognition element for splicing modifier (REMS)
  misc_feature (8)..(8): n is a, c, g, or t
gagagtrngc

SEQ ID NO: 2362 - DNA, 10 bp, Artificial Sequence
  intronic recognition element for splicing modifier (REMS)
  misc_feature (8)..(8): n is a, c, g, or t
tagagtrngc

SEQ ID NO: 2363 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtrngc

SEQ ID NO: 2364 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtrngc

SEQ ID NO: 2365 - DNA, 10 bp, Artificial Sequence
  intronic recognition element for splicing modifier (REMS)
  misc_feature (8)..(8): n is a, c, g, or t
acgagtrngc

SEQ ID NO: 2366 - DNA, 10 bp, Artificial Sequence
  intronic recognition element for splicing modifier (REMS)
  misc_feature (8)..(8): n is a, c, g, or t
ccgagtrngc

SEQ ID NO: 2367 - DNA, 10 bp, Artificial Sequence
  intronic recognition element for splicing modifier (REMS)
  misc_feature (8)..(8): n is a, c, g, or t
gcgagtrngc

SEQ ID NO: 2368 - DNA, 10 bp, Artificial Sequence
  intronic recognition element for splicing modifier (REMS)
  misc_feature (8)..(8): n is a, c, g, or t
tcgagtrngc

SEQ ID NO: 2369 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtrngc

SEQ ID NO: 2370 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtrngc

SEQ ID NO: 2371 - DNA, 10 bp, Artificial Sequence
  intronic recognition element for splicing modifier (REMS)
  misc_feature (8)..(8): n is a, c, g, or t
aggagtrngc

SEQ ID NO: 2372 - DNA, 10 bp, Artificial Sequence
  intronic recognition element for splicing modifier (REMS)
  misc_feature (8)..(8): n is a, c, g, or t
cggagtrngc

SEQ ID NO: 2373 - DNA, 10 bp, Artificial Sequence
  intronic recognition element for splicing modifier (REMS)
  misc_feature (8)..(8): n is a, c, g, or t
gggagtrngc

SEQ ID NO: 2374 - DNA, 10 bp, Artificial Sequence
  intronic recognition element for splicing modifier (REMS)
  misc_feature (8)..(8): n is a, c, g, or t
tggagtrngc

SEQ ID NO: 2375 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtrngc

SEQ ID NO: 2376 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtrngc

SEQ ID NO: 2377 - DNA, 10 bp, Artificial Sequence
  intronic recognition element for splicing modifier (REMS)
  misc_feature (8)..(8): n is a, c, g, or t
atgagtrngc

SEQ ID NO: 2378 - DNA, 10 bp, Artificial Sequence
  intronic recognition element for splicing modifier (REMS)
  misc_feature (8)..(8): n is a, c, g, or t
ctgagtrngc

SEQ ID NO: 2379 - DNA, 10 bp, Artificial Sequence
  intronic recognition element for splicing modifier (REMS)
  misc_feature (8)..(8): n is a, c, g, or t
gtgagtrngc

SEQ ID NO: 2380 - DNA, 10 bp, Artificial Sequence
  intronic recognition element for splicing modifier (REMS)
  misc_feature (8)..(8): n is a, c, g, or t
ttgagtrngc

SEQ ID NO: 2381 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtrngg

SEQ ID NO: 2382 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtrngg

SEQ ID NO: 2383 - DNA, 10 bp, Artificial Sequence
  intronic recognition element for splicing modifier (REMS)
  misc_feature (8)..(8): n is a, c, g, or t
aagagtrngg

SEQ ID NO: 2384 - DNA, 10 bp, Artificial Sequence
  intronic recognition element for splicing modifier (REMS)
  misc_feature (8)..(8): n is a, c, g, or t
cagagtrngg

SEQ ID NO: 2385 - DNA, 10 bp, Artificial Sequence
  intronic recognition element for splicing modifier (REMS)
  misc_feature (8)..(8): n is a, c, g, or t
gagagtrngg

SEQ ID NO: 2386 - DNA, 10 bp, Artificial Sequence
  intronic recognition element for splicing modifier (REMS)
  misc_feature (8)..(8): n is a, c, g, or t
tagagtrngg

SEQ ID NO: 2387 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtrngg

SEQ ID NO: 2388 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtrngg

SEQ ID NO: 2389 - DNA, 10 bp, Artificial Sequence
  intronic recognition element for splicing modifier (REMS)
  misc_feature (8)..(8): n is a, c, g, or t
acgagtrngg

SEQ ID NO: 2390 - DNA, 10 bp, Artificial Sequence
  intronic recognition element for splicing modifier (REMS)
  misc_feature (8)..(8): n is a, c, g, or t
ccgagtrngg

SEQ ID NO: 2391 - DNA, 10 bp, Artificial Sequence
  intronic recognition element for splicing modifier (REMS)
  misc_feature (8)..(8): n is a, c, g, or t
gcgagtrngg

SEQ ID NO: 2392 - DNA, 10 bp, Artificial Sequence
  intronic recognition element for splicing modifier (REMS)
  misc_feature (8)..(8): n is a, c, g, or t
tcgagtrngg

SEQ ID NO: 2393 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtrngg

SEQ ID NO: 2394 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtrngg

SEQ ID NO: 2395 - DNA, 10 bp, Artificial Sequence
  intronic recognition element for splicing modifier (REMS)
  misc_feature (8)..(8): n is a, c, g, or t
aggagtrngg

SEQ ID NO: 2396 - DNA, 10 bp, Artificial Sequence
  intronic recognition element for splicing modifier (REMS)
  misc_feature (8)..(8): n is a, c, g, or t
cggagtrngg

SEQ ID NO: 2397 - DNA, 10 bp, Artificial Sequence
  intronic recognition element for splicing modifier (REMS)
  misc_feature (8)..(8): n is a, c, g, or t
gggagtrngg

SEQ ID NO: 2398 - DNA, 10 bp, Artificial Sequence
  intronic recognition element for splicing modifier (REMS)
  misc_feature (8)..(8): n is a, c, g, or t
tggagtrngg

SEQ ID NO: 2399 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtrngg

SEQ ID NO: 2400 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtrngg

SEQ ID NO: 2401 - DNA, 10 bp, Artificial Sequence
  intronic recognition element for splicing modifier (REMS)
  misc_feature (8)..(8): n is a, c, g, or t
atgagtrngg

SEQ ID NO: 2402 - DNA, 10 bp, Artificial Sequence
  intronic recognition element for splicing modifier (REMS)
  misc_feature (8)..(8): n is a, c, g, or t
ctgagtrngg

SEQ ID NO: 2403 - DNA, 10 bp, Artificial Sequence
  intronic recognition element for splicing modifier (REMS)
  misc_feature (8)..(8): n is a, c, g, or t
gtgagtrngg

SEQ ID NO: 2404 - DNA, 10 bp, Artificial Sequence
  intronic recognition element for splicing modifier (REMS)
  misc_feature (8)..(8): n is a, c, g, or t
ttgagtrngg

SEQ ID NO: 2405 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtrngt

SEQ ID NO: 2406 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtrngt

SEQ ID NO: 2407 - DNA, 10 bp, Artificial Sequence
  intronic recognition element for splicing modifier (REMS)
  misc_feature (8)..(8): n is a, c, g, or t
aagagtrngt

SEQ ID NO: 2408 - DNA, 10 bp, Artificial Sequence
  intronic recognition element for splicing modifier (REMS)
  misc_feature (8)..(8): n is a, c, g, or t
cagagtrngt

SEQ ID NO: 2409 - DNA, 10 bp, Artificial Sequence
  intronic recognition element for splicing modifier (REMS)
  misc_feature (8)..(8): n is a, c, g, or t
gagagtrngt

SEQ ID NO: 2410 - DNA, 10 bp, Artificial Sequence
  intronic recognition element for splicing modifier (REMS)
  misc_feature (8)..(8): n is a, c, g, or t
tagagtrngt

SEQ ID NO: 2411 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtrngt

SEQ ID NO: 2412 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtrngt

SEQ ID NO: 2413 - DNA, 10 bp, Artificial Sequence
  intronic recognition element for splicing modifier (REMS)
  misc_feature (8)..(8): n is a, c, g, or t
acgagtrngt

SEQ ID NO: 2414 - DNA, 10 bp, Artificial Sequence
  intronic recognition element for splicing modifier (REMS)
  misc_feature (8)..(8): n is a, c, g, or t
ccgagtrngt

SEQ ID NO: 2415 - DNA, 10 bp, Artificial Sequence
  intronic recognition element for splicing modifier (REMS)
  misc_feature (8)..(8): n is a, c, g, or t
gcgagtrngt

SEQ ID NO: 2416 - DNA, 10 bp, Artificial Sequence
  intronic recognition element for splicing modifier (REMS)
  misc_feature (8)..(8): n is a, c, g, or t
tcgagtrngt

SEQ ID NO: 2417 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtrngt

SEQ ID NO: 2418 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtrngt

SEQ ID NO: 2419 - DNA, 10 bp, Artificial Sequence
  intronic recognition element for splicing modifier (REMS)
  misc_feature (8)..(8): n is a, c, g, or t
aggagtrngt

SEQ ID NO: 2420 - DNA, 10 bp, Artificial Sequence
  intronic recognition element for splicing modifier (REMS)
  misc_feature (8)..(8): n is a, c, g, or t
cggagtrngt

SEQ ID NO: 2421 - DNA, 10 bp, Artificial Sequence
  intronic recognition element for splicing modifier (REMS)
  misc_feature (8)..(8): n is a, c, g, or t
gggagtrngt

SEQ ID NO: 2422 - DNA, 10 bp, Artificial Sequence
  intronic recognition element for splicing modifier (REMS)
  misc_feature (8)..(8): n is a, c, g, or t
tggagtrngt

SEQ ID NO: 2423 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtrngt

SEQ ID NO: 2424 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtrngt

SEQ ID NO: 2425 - DNA, 10 bp, Artificial Sequence
  intronic recognition element for splicing modifier (REMS)
  misc_feature (8)..(8): n is a, c, g, or t
atgagtrngt

SEQ ID NO: 2426 - DNA, 10 bp, Artificial Sequence
  intronic recognition element for splicing modifier (REMS)
  misc_feature (8)..(8): n is a, c, g, or t
ctgagtrngt

SEQ ID NO: 2427 - DNA, 10 bp, Artificial Sequence
  intronic recognition element for splicing modifier (REMS)
  misc_feature (8)..(8): n is a, c, g, or t
gtgagtrngt

SEQ ID NO: 2428 - DNA, 10 bp, Artificial Sequence
  intronic recognition element for splicing modifier (REMS)
  misc_feature (8)..(8): n is a, c, g, or t
ttgagtrngt

SEQ ID NO: 2429 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
angagtangn

SEQ ID NO: 2430 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
nagagtangn

SEQ ID NO: 2431 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
aagagtangn

SEQ ID NO: 2432 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
cagagtangn

SEQ ID NO: 2433 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gagagtangn

SEQ ID NO: 2434 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tagagtangn

SEQ ID NO: 2435 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
cngagtangn

SEQ ID NO: 2436 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
ncgagtangn

SEQ ID NO: 2437 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
acgagtangn

SEQ ID NO: 2438 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ccgagtangn

SEQ ID NO: 2439 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gcgagtangn

SEQ ID NO: 2440 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tcgagtangn

SEQ ID NO: 2441 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
gngagtangn

SEQ ID NO: 2442 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
nggagtangn

SEQ ID NO: 2443 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
aggagtangn

SEQ ID NO: 2444 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
cggagtangn

SEQ ID NO: 2445 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gggagtangn

SEQ ID NO: 2446 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tggagtangn

SEQ ID NO: 2447 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
tngagtangn

SEQ ID NO: 2448 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
ntgagtangn

SEQ ID NO: 2449 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
atgagtangn

SEQ ID NO: 2450 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ctgagtangn

SEQ ID NO: 2451 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gtgagtangn

SEQ ID NO: 2452 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ttgagtangn

SEQ ID NO: 2453 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtaagn

SEQ ID NO: 2454 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtaagn

SEQ ID NO: 2455 - DNA, 10 bp, Artificial Sequence
  intronic recognition element for splicing modifier (REMS)
  misc_feature (10)..(10): n is a, c, g, or t
aagagtaagn

SEQ ID NO: 2456 - DNA, 10 bp, Artificial Sequence
  intronic recognition element for splicing modifier (REMS)
  misc_feature (10)..(10): n is a, c, g, or t
cagagtaagn

SEQ ID NO: 2457 - DNA, 10 bp, Artificial Sequence
  intronic recognition element for splicing modifier (REMS)
  misc_feature (10)..(10): n is a, c, g, or t
gagagtaagn

SEQ ID NO: 2458 - DNA, 10 bp, Artificial Sequence
  intronic recognition element for splicing modifier (REMS)
  misc_feature (10)..(10): n is a, c, g, or t
tagagtaagn

SEQ ID NO: 2459 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtaagn

SEQ ID NO: 2460 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtaagn

SEQ ID NO: 2461 - DNA, 10 bp, Artificial Sequence
  intronic recognition element for splicing modifier (REMS)
  misc_feature (10)..(10): n is a, c, g, or t
acgagtaagn

SEQ ID NO: 2462 - DNA, 10 bp, Artificial Sequence
  intronic recognition element for splicing modifier (REMS)
  misc_feature (10)..(10): n is a, c, g, or t
ccgagtaagn

SEQ ID NO: 2463 - DNA, 10 bp, Artificial Sequence
  intronic recognition element for splicing modifier (REMS)
  misc_feature (10)..(10): n is a, c, g, or t
gcgagtaagn

SEQ ID NO: 2464 - DNA, 10 bp, Artificial Sequence
  intronic recognition element for splicing modifier (REMS)
  misc_feature (10)..(10): n is a, c, g, or t
tcgagtaagn

SEQ ID NO: 2465 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtaagn

SEQ ID NO: 2466 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtaagn

SEQ ID NO: 2467 - DNA, 10 bp, Artificial Sequence
  intronic recognition element for splicing modifier (REMS)
  misc_feature (10)..(10): n is a, c, g, or t
aggagtaagn

SEQ ID NO: 2468 - DNA, 10 bp, Artificial Sequence
  intronic recognition element for splicing modifier (REMS)
  misc_feature (10)..(10): n is a, c, g, or t
cggagtaagn

SEQ ID NO: 2469 - DNA, 10 bp, Artificial Sequence
  intronic recognition element for splicing modifier (REMS)
  misc_feature (10)..(10): n is a, c, g, or t
gggagtaagn

SEQ ID NO: 2470 - DNA, 10 bp, Artificial Sequence
  intronic recognition element for splicing modifier (REMS)
  misc_feature (10)..(10): n is a, c, g, or t
tggagtaagn

SEQ ID NO: 2471 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtaagn

SEQ ID NO: 2472 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtaagn

SEQ ID NO: 2473 - DNA, 10 bp, Artificial Sequence
  intronic recognition element for splicing modifier (REMS)
  misc_feature (10)..(10): n is a, c, g, or t
atgagtaagn

SEQ ID NO: 2474 - DNA, 10 bp, Artificial Sequence
  intronic recognition element for splicing modifier (REMS)
  misc_feature (10)..(10): n is a, c, g, or t
ctgagtaagn

SEQ ID NO: 2475 - DNA, 10 bp, Artificial Sequence
  intronic recognition element for splicing modifier (REMS)
  misc_feature (10)..(10): n is a, c, g, or t
gtgagtaagn

SEQ ID NO: 2476 - DNA, 10 bp, Artificial Sequence
  intronic recognition element for splicing modifier (REMS)
  misc_feature (10)..(10): n is a, c, g, or t
ttgagtaagn

SEQ ID NO: 2477 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtacgn

SEQ ID NO: 2478 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtacgn

SEQ ID NO: 2479 - DNA, 10 bp, Artificial Sequence
  intronic recognition element for splicing modifier (REMS)
  misc_feature (10)..(10): n is a, c, g, or t
aagagtacgn

SEQ ID NO: 2480 - DNA, 10 bp, Artificial Sequence
  intronic recognition element for splicing modifier (REMS)
  misc_feature (10)..(10): n is a, c, g, or t
cagagtacgn

SEQ ID NO: 2481 - DNA, 10 bp, Artificial Sequence
  intronic recognition element for splicing modifier (REMS)
  misc_feature (10)..(10): n is a, c, g, or t
gagagtacgn

SEQ ID NO: 2482 - DNA, 10 bp, Artificial Sequence
  intronic recognition element for splicing modifier (REMS)
  misc_feature (10)..(10): n is a, c, g, or t
tagagtacgn

SEQ ID NO: 2483 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtacgn

SEQ ID NO: 2484 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtacgn

SEQ ID NO: 2485 - DNA, 10 bp, Artificial Sequence
  intronic recognition element for splicing modifier (REMS)
  misc_feature (10)..(10): n is a, c, g, or t
acgagtacgn

SEQ ID NO: 2486 - DNA, 10 bp, Artificial Sequence
  intronic recognition element for splicing modifier (REMS)
  misc_feature (10)..(10): n is a, c, g, or t
ccgagtacgn

SEQ ID NO: 2487 - DNA, 10 bp, Artificial Sequence
  intronic recognition element for splicing modifier (REMS)
  misc_feature (10)..(10): n is a, c, g, or t
gcgagtacgn

SEQ ID NO: 2488 - DNA, 10 bp, Artificial Sequence
  intronic recognition element for splicing modifier (REMS)
  misc_feature (10)..(10): n is a, c, g, or t
tcgagtacgn

SEQ ID NO: 2489 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtacgn

SEQ ID NO: 2490 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtacgn

SEQ ID NO: 2491 - DNA, 10 bp, Artificial Sequence
  intronic recognition element for splicing modifier (REMS)
  misc_feature (10)..(10): n is a, c, g, or t
aggagtacgn

SEQ ID NO: 2492 - DNA, 10 bp, Artificial Sequence
  intronic recognition element for splicing modifier (REMS)
  misc_feature (10)..(10): n is a, c, g, or t
cggagtacgn

SEQ ID NO: 2493 - DNA, 10 bp, Artificial Sequence
  intronic recognition element for splicing modifier (REMS)
  misc_feature (10)..(10): n is a, c, g, or t
gggagtacgn

SEQ ID NO: 2494 - DNA, 10 bp, Artificial Sequence
  intronic recognition element for splicing modifier (REMS)
  misc_feature (10)..(10): n is a, c, g, or t
tggagtacgn

SEQ ID NO: 2495 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtacgn

SEQ ID NO: 2496 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtacgn

SEQ ID NO: 2497 - DNA, 10 bp, Artificial Sequence
  intronic recognition element for splicing modifier (REMS)
  misc_feature (10)..(10): n is a, c, g, or t
atgagtacgn

SEQ ID NO: 2498 - DNA, 10 bp, Artificial Sequence
  intronic recognition element for splicing modifier (REMS)
  misc_feature (10)..(10): n is a, c, g, or t
ctgagtacgn

SEQ ID NO: 2499 - DNA, 10 bp, Artificial Sequence
  intronic recognition element for splicing modifier (REMS)
  misc_feature (10)..(10): n is a, c, g, or t
gtgagtacgn

SEQ ID NO: 2500 - DNA, 10 bp, Artificial Sequence
  intronic recognition element for splicing modifier (REMS)
  misc_feature (10)..(10): n is a, c, g, or t
ttgagtacgn

SEQ ID NO: 2501 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtaggn

SEQ ID NO: 2502 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtaggn

SEQ ID NO: 2503 - DNA, 10 bp, Artificial Sequence
  intronic recognition element for splicing modifier (REMS)
  misc_feature (10)..(10): n is a, c, g, or t
aagagtaggn

SEQ ID NO: 2504 - DNA, 10 bp, Artificial Sequence
  intronic recognition element for splicing modifier (REMS)
  misc_feature (10)..(10): n is a, c, g, or t
cagagtaggn

SEQ ID NO: 2505 - DNA, 10 bp, Artificial Sequence
  intronic recognition element for splicing modifier (REMS)
  misc_feature (10)..(10): n is a, c, g, or t
gagagtaggn

SEQ ID NO: 2506 - DNA, 10 bp, Artificial Sequence
  intronic recognition element for splicing modifier (REMS)
  misc_feature (10)..(10): n is a, c, g, or t
tagagtaggn

SEQ ID NO: 2507 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtaggn

SEQ ID NO: 2508 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtaggn

SEQ ID NO: 2509 - DNA, 10 bp, Artificial Sequence
  intronic recognition element for splicing modifier (REMS)
  misc_feature (10)..(10): n is a, c, g, or t
acgagtaggn

SEQ ID NO: 2510 - DNA, 10 bp, Artificial Sequence
  intronic recognition element for splicing modifier (REMS)
  misc_feature (10)..(10): n is a, c, g, or t
ccgagtaggn

SEQ ID NO: 2511 - DNA, 10 bp, Artificial Sequence
  intronic recognition element for splicing modifier (REMS)
  misc_feature (10)..(10): n is a, c, g, or t
gcgagtaggn

SEQ ID NO: 2512 - DNA, 10 bp, Artificial Sequence
  intronic recognition element for splicing modifier (REMS)
  misc_feature (10)..(10): n is a, c, g, or t
tcgagtaggn

SEQ ID NO: 2513 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtaggn

SEQ ID NO: 2514 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtaggn

SEQ ID NO: 2515 - DNA, 10 bp, Artificial Sequence
  intronic recognition element for splicing modifier (REMS)
  misc_feature (10)..(10): n is a, c, g, or t
aggagtaggn

SEQ ID NO: 2516 - DNA, 10 bp, Artificial Sequence
  intronic recognition element for splicing modifier (REMS)
  misc_feature (10)..(10): n is a, c, g, or t
cggagtaggn

SEQ ID NO: 2517 - DNA, 10 bp, Artificial Sequence
  intronic recognition element for splicing modifier (REMS)
  misc_feature (10)..(10): n is a, c, g, or t
gggagtaggn

SEQ ID NO: 2518 - DNA, 10 bp, Artificial Sequence
  intronic recognition element for splicing modifier (REMS)
  misc_feature (10)..(10): n is a, c, g, or t
tggagtaggn

SEQ ID NO: 2519 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtaggn

SEQ ID NO: 2520 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtaggn

SEQ ID NO: 2521 - DNA, 10 bp, Artificial Sequence
  intronic recognition element for splicing modifier (REMS)
  misc_feature (10)..(10): n is a, c, g, or t
atgagtaggn

SEQ ID NO: 2522 - DNA, 10 bp, Artificial Sequence
  intronic recognition element for splicing modifier (REMS)
  misc_feature (10)..(10): n is a, c, g, or t
ctgagtaggn

SEQ ID NO: 2523 - DNA, 10 bp, Artificial Sequence
  intronic recognition element for splicing modifier (REMS)
  misc_feature (10)..(10): n is a, c, g, or t
gtgagtaggn

SEQ ID NO: 2524 - DNA, 10 bp, Artificial Sequence
  intronic recognition element for splicing modifier (REMS)
  misc_feature (10)..(10): n is a, c, g, or t
ttgagtaggn

SEQ ID NO: 2525 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtatgn

SEQ ID NO: 2526 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtatgn

SEQ ID NO: 2527 - DNA, 10 bp, Artificial Sequence
  intronic recognition element for splicing modifier (REMS)
  misc_feature (10)..(10): n is a, c, g, or t
aagagtatgn

SEQ ID NO: 2528 - DNA, 10 bp, Artificial Sequence
  intronic recognition element for splicing modifier (REMS)
  misc_feature (10)..(10): n is a, c, g, or t
cagagtatgn

SEQ ID NO: 2529 - DNA, 10 bp, Artificial Sequence
  intronic recognition element for splicing modifier (REMS)
  misc_feature (10)..(10): n is a, c, g, or t
gagagtatgn

SEQ ID NO: 2530 - DNA, 10 bp, Artificial Sequence
  intronic recognition element for splicing modifier (REMS)
  misc_feature (10)..(10): n is a, c, g, or t
tagagtatgn

SEQ ID NO: 2531 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtatgn

SEQ ID NO: 2532 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtatgn

SEQ ID NO: 2533 - DNA, 10 bp, Artificial Sequence
  intronic recognition element for splicing modifier (REMS)
  misc_feature (10)..(10): n is a, c, g, or t
acgagtatgn

SEQ ID NO: 2534 - DNA, 10 bp, Artificial Sequence
  intronic recognition element for splicing modifier (REMS)
  misc_feature (10)..(10): n is a, c, g, or t
ccgagtatgn

SEQ ID NO: 2535 - DNA, 10 bp, Artificial Sequence
  intronic recognition element for splicing modifier (REMS)
  misc_feature (10)..(10): n is a, c, g, or t
gcgagtatgn

SEQ ID NO: 2536 - DNA, 10 bp, Artificial Sequence
  intronic recognition element for splicing modifier (REMS)
  misc_feature (10)..(10): n is a, c, g, or t
tcgagtatgn

SEQ ID NO: 2537 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtatgn

SEQ ID NO: 2538 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtatgn

SEQ ID NO: 2539 - DNA, 10 bp, Artificial Sequence
  intronic recognition element for splicing modifier (REMS)
  misc_feature (10)..(10): n is a, c, g, or t
aggagtatgn

SEQ ID NO: 2540 - DNA, 10 bp, Artificial Sequence
  intronic recognition element for splicing modifier (REMS)
  misc_feature (10)..(10): n is a, c, g, or t
cggagtatgn

SEQ ID NO: 2541 - DNA, 10 bp, Artificial Sequence
  intronic recognition element for splicing modifier (REMS)
  misc_feature (10)..(10): n is a, c, g, or t
gggagtatgn

SEQ ID NO: 2542 - DNA, 10 bp, Artificial Sequence
  intronic recognition element for splicing modifier (REMS)
  misc_feature (10)..(10): n is a, c, g, or t
tggagtatgn

SEQ ID NO: 2543 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtatgn

SEQ ID NO: 2544 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtatgn

SEQ ID NO: 2545 - DNA, 10 bp, Artificial Sequence
  intronic recognition element for splicing modifier (REMS)
  misc_feature (10)..(10): n is a, c, g, or t
atgagtatgn

SEQ ID NO: 2546 - DNA, 10 bp, Artificial Sequence
  intronic recognition element for splicing modifier (REMS)
  misc_feature (10)..(10): n is a, c, g, or t
ctgagtatgn

SEQ ID NO: 2547 - DNA, 10 bp, Artificial Sequence
  intronic recognition element for splicing modifier (REMS)
  misc_feature (10)..(10): n is a, c, g, or t
gtgagtatgn

SEQ ID NO: 2548 - DNA, 10 bp, Artificial Sequence
  intronic recognition element for splicing modifier (REMS)
  misc_feature (10)..(10): n is a, c, g, or t
ttgagtatgn

SEQ ID NO: 2549 - DNA, 10 bp, Artificial Sequence
  intronic recognition element for splicing modifier (REMS)
  misc_feature (2)..(2): n is a, c, g, or t
angagtaaga

SEQ ID NO: 2550 - DNA, 10 bp, Artificial Sequence
  intronic recognition element for splicing modifier (REMS)
  misc_feature (1)..(1): n is a, c, g, or t
nagagtaaga

SEQ ID NO: 2551 - DNA, 10 bp, Artificial Sequence
  intronic recognition element for splicing modifier (REMS)
aagagtaaga

SEQ ID NO: 2552 - DNA, 10 bp, Artificial Sequence
  intronic recognition element for splicing modifier (REMS)
cagagtaaga

SEQ ID NO: 2553 - DNA, 10 bp, Artificial Sequence
  intronic recognition element for splicing modifier (REMS)
gagagtaaga

SEQ ID NO: 2554 - DNA, 10 bp, Artificial Sequence
  intronic recognition element for splicing modifier (REMS)
tagagtaaga

SEQ ID NO: 2555 - DNA, 10 bp, Artificial Sequence
  intronic recognition element for splicing modifier (REMS)
  misc_feature (2)..(2): n is a, c, g, or t
cngagtaaga

SEQ ID NO: 2556 - DNA, 10 bp, Artificial Sequence
  intronic recognition element for splicing modifier (REMS)
  misc_feature (1)..(1): n is a, c, g, or t
ncgagtaaga

SEQ ID NO: 2557 - DNA, 10 bp, Artificial Sequence
  intronic recognition element for splicing modifier (REMS)
acgagtaaga

SEQ ID NO: 2558 - DNA, 10 bp, Artificial Sequence
  intronic recognition element for splicing modifier (REMS)
ccgagtaaga

SEQ ID NO: 2559 - DNA, 10 bp, Artificial Sequence
  intronic recognition element for splicing modifier (REMS)
gcgagtaaga

SEQ ID NO: 2560 - DNA, 10 bp, Artificial Sequence
  intronic recognition element for splicing modifier (REMS)
tcgagtaaga

SEQ ID NO: 2561 - DNA, 10 bp, Artificial Sequence
  intronic recognition element for splicing modifier (REMS)
  misc_feature (2)..(2): n is a, c, g, or t
gngagtaaga

SEQ ID NO: 2562 - DNA, 10 bp, Artificial Sequence
  intronic recognition element for splicing modifier (REMS)
  misc_feature (1)..(1): n is a, c, g, or t
nggagtaaga

SEQ ID NO: 2563 - DNA, 10 bp, Artificial Sequence
  intronic recognition element for splicing modifier (REMS)
aggagtaaga

SEQ ID NO: 2564 - DNA, 10 bp, Artificial Sequence
  intronic recognition element for splicing modifier (REMS)
cggagtaaga

SEQ ID NO: 2565 - DNA, 10 bp, Artificial Sequence
  intronic recognition element for splicing modifier (REMS)
gggagtaaga

SEQ ID NO: 2566 - DNA, 10 bp, Artificial Sequence
  intronic recognition element for splicing modifier (REMS)
tggagtaaga

SEQ ID NO: 2567 - DNA, 10 bp, Artificial Sequence
  intronic recognition element for splicing modifier (REMS)
  misc_feature (2)..(2): n is a, c, g, or t
tngagtaaga

SEQ ID NO: 2568 - DNA, 10 bp, Artificial Sequence
  intronic recognition element for splicing modifier (REMS)
  misc_feature (1)..(1): n is a, c, g, or t
ntgagtaaga

SEQ ID NO: 2569 - DNA, 10 bp, Artificial Sequence
  intronic recognition element for splicing modifier (REMS)
atgagtaaga

SEQ ID NO: 2570 - DNA, 10 bp, Artificial Sequence
  intronic recognition element for splicing modifier (REMS)
ctgagtaaga

SEQ ID NO: 2571 - DNA, 10 bp, Artificial Sequence
  intronic recognition element for splicing modifier (REMS)
gtgagtaaga

SEQ ID NO: 2572 - DNA, 10 bp, Artificial Sequence
  intronic recognition element for splicing modifier (REMS)
ttgagtaaga

SEQ ID NO: 2573 - DNA, 10 bp, Artificial Sequence
  intronic recognition element for splicing modifier (REMS)
  misc_feature (2)..(2): n is a, c, g, or t
angagtacga

SEQ ID NO: 2574 - DNA, 10 bp, Artificial Sequence
  intronic recognition element for splicing modifier (REMS)
  misc_feature (1)..(1): n is a, c, g, or t
nagagtacga

SEQ ID NO: 2575 - DNA, 10 bp, Artificial Sequence
  intronic recognition element for splicing modifier (REMS)
aagagtacga

SEQ ID NO: 2576 - DNA, 10 bp, Artificial Sequence
  intronic recognition element for splicing modifier (REMS)
cagagtacga

SEQ ID NO: 2577 - DNA, 10 bp, Artificial Sequence
  intronic recognition element for splicing modifier (REMS)
gagagtacga

SEQ ID NO: 2578 - DNA, 10 bp, Artificial Sequence
  intronic recognition element for splicing modifier (REMS)
tagagtacga

SEQ ID NO: 2579 - DNA, 10 bp, Artificial Sequence
  intronic recognition element for splicing modifier (REMS)
  misc_feature (2)..(2): n is a, c, g, or t
cngagtacga

SEQ ID NO: 2580 - DNA, 10 bp, Artificial Sequence
  intronic recognition element for splicing modifier (REMS)
  misc_feature (1)..(1): n is a, c, g, or t
ncgagtacga

SEQ ID NO: 2581 - DNA, 10 bp, Artificial Sequence
  intronic recognition element for splicing modifier (REMS)
acgagtacga

SEQ ID NO: 2582 - DNA, 10 bp, Artificial Sequence
  intronic recognition element for splicing modifier (REMS)
ccgagtacga

SEQ ID NO: 2583 - DNA, 10 bp, Artificial Sequence
  intronic recognition element for splicing modifier (REMS)
gcgagtacga

SEQ ID NO: 2584 - DNA, 10 bp, Artificial Sequence
  intronic recognition element for splicing modifier (REMS)
tcgagtacga

SEQ ID NO: 2585 - DNA, 10 bp, Artificial Sequence
  intronic recognition element for splicing modifier (REMS)
  misc_feature (2)..(2): n is a, c, g, or t
gngagtacga

SEQ ID NO: 2586 - DNA, 10 bp, Artificial Sequence
  intronic recognition element for splicing modifier (REMS)
  misc_feature (1)..(1): n is a, c, g, or t
nggagtacga

SEQ ID NO: 2587 - DNA, 10 bp, Artificial Sequence
  intronic recognition element for splicing modifier (REMS)
aggagtacga

SEQ ID NO: 2588 - DNA, 10 bp, Artificial Sequence
  intronic recognition element for splicing modifier (REMS)
cggagtacga

SEQ ID NO: 2589 - DNA, 10 bp, Artificial Sequence
  intronic recognition element for splicing modifier (REMS)
gggagtacga

SEQ ID NO: 2590 - DNA, 10 bp, Artificial Sequence
  intronic recognition element for splicing modifier (REMS)
tggagtacga

SEQ ID NO: 2591 - DNA, 10 bp, Artificial Sequence
  intronic recognition element for splicing modifier (REMS)
  misc_feature (2)..(2): n is a, c, g, or t
tngagtacga

SEQ ID NO: 2592 - DNA, 10 bp, Artificial Sequence
  intronic recognition element for splicing modifier (REMS)
  misc_feature (1)..(1): n is a, c, g, or t
ntgagtacga

SEQ ID NO: 2593 - DNA, 10 bp, Artificial Sequence
  intronic recognition element for splicing modifier (REMS)
atgagtacga

SEQ ID NO: 2594 - DNA, 10 bp, Artificial Sequence
  intronic recognition element for splicing modifier (REMS)
ctgagtacga

SEQ ID NO: 2595 - DNA, 10 bp, Artificial Sequence
  intronic recognition element for splicing modifier (REMS)
gtgagtacga

SEQ ID NO: 2596 - DNA, 10 bp, Artificial Sequence
  intronic recognition element for splicing modifier (REMS)
ttgagtacga

SEQ ID NO: 2597 - DNA, 10 bp, Artificial Sequence
  intronic recognition element for splicing modifier (REMS)
  misc_feature (2)..(2): n is a, c, g, or t
angagtagga

SEQ ID NO: 2598 - DNA, 10 bp, Artificial Sequence
  intronic recognition element for splicing modifier (REMS)
  misc_feature (1)..(1): n is a, c, g, or t
nagagtagga

SEQ ID NO: 2599 - DNA, 10 bp, Artificial Sequence
  intronic recognition element for splicing modifier (REMS)
aagagtagga

SEQ ID NO: 2600 - DNA, 10 bp, Artificial Sequence
  intronic recognition element for splicing modifier (REMS)
cagagtagga

SEQ ID NO: 2601 - DNA, 10 bp, Artificial Sequence
  intronic recognition element for splicing modifier (REMS)
gagagtagga

SEQ ID NO: 2602 - DNA, 10 bp, Artificial Sequence
  intronic recognition element for splicing modifier (REMS)
tagagtagga

SEQ ID NO: 2603 - DNA, 10 bp, Artificial Sequence
  intronic recognition element for splicing modifier (REMS)
  misc_feature (2)..(2): n is a, c, g, or t
cngagtagga

SEQ ID NO: 2604 - DNA, 10 bp, Artificial Sequence
  intronic recognition element for splicing modifier (REMS)
  misc_feature (1)..(1): n is a, c, g, or t
ncgagtagga

SEQ ID NO: 2605 - DNA, 10 bp, Artificial Sequence
  intronic recognition element for splicing modifier (REMS)
acgagtagga

SEQ ID NO: 2606 - DNA, 10 bp, Artificial Sequence
  intronic recognition element for splicing modifier (REMS)
ccgagtagga

SEQ ID NO: 2607 - DNA, 10 bp, Artificial Sequence
  intronic recognition element for splicing modifier (REMS)
gcgagtagga

SEQ ID NO: 2608 - DNA, 10 bp, Artificial Sequence
  intronic recognition element for splicing modifier (REMS)
tcgagtagga

SEQ ID NO: 2609 - DNA, 10 bp, Artificial Sequence
  intronic recognition element for splicing modifier (REMS)
  misc_feature (2)..(2): n is a, c, g, or t
gngagtagga

SEQ ID NO: 2610 - DNA, 10 bp, Artificial Sequence
  intronic recognition element for splicing modifier (REMS)
  misc_feature (1)..(1): n is a, c, g, or t
nggagtagga

SEQ ID NO: 2611 - DNA, 10 bp, Artificial Sequence
  intronic recognition element for splicing modifier (REMS)
aggagtagga

SEQ ID NO: 2612 - DNA, 10 bp, Artificial Sequence
  intronic recognition element for splicing modifier (REMS)
cggagtagga

SEQ ID NO: 2613 - DNA, 10 bp, Artificial Sequence
  intronic recognition element for splicing modifier (REMS)
gggagtagga

SEQ ID NO: 2614 - DNA, 10 bp, Artificial Sequence
  intronic recognition element for splicing modifier (REMS)
tggagtagga

SEQ ID NO: 2615 - DNA, 10 bp, Artificial Sequence
  intronic recognition element for splicing modifier (REMS)
  misc_feature (2)..(2): n is a, c, g, or t
tngagtagga

SEQ ID NO: 2616 - DNA, 10 bp, Artificial Sequence
  intronic recognition element for splicing modifier (REMS)
  misc_feature (1)..(1): n is a, c, g, or t
ntgagtagga

SEQ ID NO: 2617 - DNA, 10 bp, Artificial Sequence
  intronic recognition element for splicing modifier (REMS)
atgagtagga

SEQ ID NO: 2618 - DNA, 10 bp, Artificial Sequence
  intronic recognition element for splicing modifier (REMS)
ctgagtagga

SEQ ID NO: 2619 - DNA, 10 bp, Artificial Sequence
  intronic recognition element for splicing modifier (REMS)
gtgagtagga

SEQ ID NO: 2620 - DNA, 10 bp, Artificial Sequence
  intronic recognition element for splicing modifier (REMS)
ttgagtagga

SEQ ID NO: 2621 - DNA, 10 bp, Artificial Sequence
  intronic recognition element for splicing modifier (REMS)
  misc_feature (2)..(2): n is a, c, g, or t
angagtatga

SEQ ID NO: 2622 - DNA, 10 bp, Artificial Sequence
  intronic recognition element for splicing modifier (REMS)
  misc_feature (1)..(1): n is a, c, g, or t
nagagtatga

SEQ ID NO: 2623 - DNA, 10 bp, Artificial Sequence
  intronic recognition element for splicing modifier (REMS)
aagagtatga

SEQ ID NO: 2624 - DNA, 10 bp, Artificial Sequence
  intronic recognition element for splicing modifier (REMS)
cagagtatga

SEQ ID NO: 2625 - DNA, 10 bp, Artificial Sequence
  intronic recognition element for splicing modifier (REMS)
gagagtatga

SEQ ID NO: 2626 - DNA, 10 bp, Artificial Sequence
  intronic recognition element for splicing modifier (REMS)
tagagtatga

SEQ ID NO: 2627 - DNA, 10 bp, Artificial Sequence
  intronic recognition element for splicing modifier (REMS)
  misc_feature (2)..(2): n is a, c, g, or t
cngagtatga

SEQ ID NO: 2628 - DNA, 10 bp, Artificial Sequence
  intronic recognition element for splicing modifier (REMS)
  misc_feature (1)..(1): n is a, c, g, or t
ncgagtatga

SEQ ID NO: 2629 - DNA, 10 bp, Artificial Sequence
  intronic recognition element for splicing modifier (REMS)
acgagtatga

SEQ ID NO: 2630 - DNA, 10 bp, Artificial Sequence
  intronic recognition element for splicing modifier (REMS)
ccgagtatga

SEQ ID NO: 2631 - DNA, 10 bp, Artificial Sequence
  intronic recognition element for splicing modifier (REMS)
gcgagtatga

SEQ ID NO: 2632 - DNA, 10 bp, Artificial Sequence
  intronic recognition element for splicing modifier (REMS)
tcgagtatga

SEQ ID NO: 2633 - DNA, 10 bp, Artificial Sequence
  intronic recognition element for splicing modifier (REMS)
  misc_feature (2)..(2): n is a, c, g, or t
gngagtatga

SEQ ID NO: 2634 - DNA, 10 bp, Artificial Sequence
  intronic recognition element for splicing modifier (REMS)
  misc_feature (1)..(1): n is a, c, g, or t
nggagtatga

SEQ ID NO: 2635 - DNA, 10 bp, Artificial Sequence
  intronic recognition element for splicing modifier (REMS)
aggagtatga

SEQ ID NO: 2636 - DNA, 10 bp, Artificial Sequence
  intronic recognition element for splicing modifier (REMS)
cggagtatga

SEQ ID NO: 2637 - DNA, 10 bp, Artificial Sequence
  intronic recognition element for splicing modifier (REMS)
gggagtatga

SEQ ID NO: 2638 - DNA, 10 bp, Artificial Sequence
  intronic recognition element for splicing modifier (REMS)
tggagtatga

SEQ ID NO: 2639 - DNA, 10 bp, Artificial Sequence
  intronic recognition element for splicing modifier (REMS)
  misc_feature (2)..(2): n is a, c, g, or t
tngagtatga

SEQ ID NO: 2640 - DNA, 10 bp, Artificial Sequence
  intronic recognition element for splicing modifier (REMS)
  misc_feature (1)..(1): n is a, c, g, or t
ntgagtatga

SEQ ID NO: 2641 - DNA, 10 bp, Artificial Sequence
  intronic recognition element for splicing modifier (REMS)
atgagtatga

SEQ ID NO: 2642 - DNA, 10 bp, Artificial Sequence
  intronic recognition element for splicing modifier (REMS)
ctgagtatga

SEQ ID NO: 2643 - DNA, 10 bp, Artificial Sequence
  intronic recognition element for splicing modifier (REMS)
gtgagtatga

SEQ ID NO: 2644 - DNA, 10 bp, Artificial Sequence
  intronic recognition element for splicing modifier (REMS)
ttgagtatga

SEQ ID NO: 2645 - DNA, 10 bp, Artificial Sequence
  intronic recognition element for splicing modifier (REMS)
  misc_feature (2)..(2): n is a, c, g, or t
angagtaagc

SEQ ID NO: 2646 - DNA, 10 bp, Artificial Sequence
  intronic recognition element for splicing modifier (REMS)
  misc_feature (1)..(1): n is a, c, g, or t
nagagtaagc

SEQ ID NO: 2647 - DNA, 10 bp, Artificial Sequence
  intronic recognition element for splicing modifier (REMS)
aagagtaagc

SEQ ID NO: 2648 - DNA, 10 bp, Artificial Sequence
  intronic recognition element for splicing modifier (REMS)
cagagtaagc

SEQ ID NO: 2649 - DNA, 10 bp, Artificial Sequence
  intronic recognition element for splicing modifier (REMS)
gagagtaagc

SEQ ID NO: 2650 - DNA, 10 bp, Artificial Sequence
  intronic recognition element for splicing modifier (REMS)
tagagtaagc

SEQ ID NO: 2651 - DNA, 10 bp, Artificial Sequence
  intronic recognition element for splicing modifier (REMS)
  misc_feature (2)..(2): n is a, c, g, or t
cngagtaagc

SEQ ID NO: 2652 - DNA, 10 bp, Artificial Sequence
  intronic recognition element for splicing modifier (REMS)
  misc_feature (1)..(1): n is a, c, g, or t
ncgagtaagc

SEQ ID NO: 2653 - DNA, 10 bp, Artificial Sequence
  intronic recognition element for splicing modifier (REMS)
acgagtaagc

SEQ ID NO: 2654 - DNA, 10 bp, Artificial Sequence
  intronic recognition element for splicing modifier (REMS)
ccgagtaagc

SEQ ID NO: 2655 - DNA, 10 bp, Artificial Sequence
  intronic recognition element for splicing modifier (REMS)
gcgagtaagc

SEQ ID NO: 2656 - DNA, 10 bp, Artificial Sequence
  intronic recognition element for splicing modifier (REMS)
tcgagtaagc

SEQ ID NO: 2657 - DNA, 10 bp, Artificial Sequence
  intronic recognition element for splicing modifier (REMS)
  misc_feature (2)..(2): n is a, c, g, or t
gngagtaagc

SEQ ID NO: 2658 - DNA, 10 bp, Artificial Sequence
  intronic recognition element for splicing modifier (REMS)
  misc_feature (1)..(1): n is a, c, g, or t
nggagtaagc

SEQ ID NO: 2659 - DNA, 10 bp, Artificial Sequence
  intronic recognition element for splicing modifier (REMS)
aggagtaagc

SEQ ID NO: 2660 - DNA, 10 bp, Artificial Sequence
  intronic recognition element for splicing modifier (REMS)
cggagtaagc

SEQ ID NO: 2661 - DNA, 10 bp, Artificial Sequence
  intronic recognition element for splicing modifier (REMS)
gggagtaagc

SEQ ID NO: 2662 - DNA, 10 bp, Artificial Sequence
  intronic recognition element for splicing modifier (REMS)
tggagtaagc

SEQ ID NO: 2663 - DNA, 10 bp, Artificial Sequence
  intronic recognition element for splicing modifier (REMS)
  misc_feature (2)..(2): n is a, c, g, or t
tngagtaagc

SEQ ID NO: 2664 - DNA, 10 bp, Artificial Sequence
  intronic recognition element for splicing modifier (REMS)
  misc_feature (1)..(1): n is a, c, g, or t
ntgagtaagc

SEQ ID NO: 2665 - DNA, 10 bp, Artificial Sequence
  intronic recognition element for splicing modifier (REMS)
atgagtaagc

SEQ ID NO: 2666 - DNA, 10 bp, Artificial Sequence
  intronic recognition element for splicing modifier (REMS)
ctgagtaagc

SEQ ID NO: 2667 - DNA, 10 bp, Artificial Sequence
  intronic recognition element for splicing modifier (REMS)
gtgagtaagc

SEQ ID NO: 2668 - DNA, 10 bp, Artificial Sequence
  intronic recognition element for splicing modifier (REMS)
ttgagtaagc

SEQ ID NO: 2669 - DNA, 10 bp, Artificial Sequence
  intronic recognition element for splicing modifier (REMS)
  misc_feature (2)..(2): n is a, c, g, or t
angagtacgc

SEQ ID NO: 2670 - DNA, 10 bp, Artificial Sequence
  intronic recognition element for splicing modifier (REMS)
  misc_feature (1)..(1): n is a, c, g, or t
nagagtacgc

SEQ ID NO: 2671 - DNA, 10 bp, Artificial Sequence
  intronic recognition element for splicing modifier (REMS)
aagagtacgc

SEQ ID NO: 2672 - DNA, 10 bp, Artificial Sequence
  intronic recognition element for splicing modifier (REMS)
cagagtacgc

SEQ ID NO: 2673 - DNA, 10 bp, Artificial Sequence
  intronic recognition element for splicing modifier (REMS)
gagagtacgc

SEQ ID NO: 2674 - DNA, 10 bp, Artificial Sequence
  intronic recognition element for splicing modifier (REMS)
tagagtacgc

SEQ ID NO: 2675 - DNA, 10 bp, Artificial Sequence
  intronic recognition element for splicing modifier (REMS)
  misc_feature (2)..(2): n is a, c, g, or t
cngagtacgc

SEQ ID NO: 2676 - DNA, 10 bp, Artificial Sequence
  intronic recognition element for splicing modifier (REMS)
  misc_feature (1)..(1): n is a, c, g, or t
ncgagtacgc

SEQ ID NO: 2677 - DNA, 10 bp, Artificial Sequence
  intronic recognition element for splicing modifier (REMS)
acgagtacgc

SEQ ID NO: 2678 - DNA, 10 bp, Artificial Sequence
  intronic recognition element for splicing modifier (REMS)
ccgagtacgc

SEQ ID NO: 2679 - DNA, 10 bp, Artificial Sequence
  intronic recognition element for splicing modifier (REMS)
gcgagtacgc

SEQ ID NO: 2680 - DNA, 10 bp, Artificial Sequence
  intronic recognition element for splicing modifier (REMS)
tcgagtacgc

SEQ ID NO: 2681 - DNA, 10 bp, Artificial Sequence
  intronic recognition element for splicing modifier (REMS)
  misc_feature (2)..(2): n is a, c, g, or t
gngagtacgc

SEQ ID NO: 2682 - DNA, 10 bp, Artificial Sequence
  intronic recognition element for splicing modifier (REMS)
  misc_feature (1)..(1): n is a, c, g, or t
nggagtacgc

SEQ ID NO: 2683 - DNA, 10 bp, Artificial Sequence
  intronic recognition element for splicing modifier (REMS)
aggagtacgc

SEQ ID NO: 2684 - DNA, 10 bp, Artificial Sequence
  intronic recognition element for splicing modifier (REMS)
cggagtacgc

SEQ ID NO: 2685 - DNA, 10 bp, Artificial Sequence
  intronic recognition element for splicing modifier (REMS)
gggagtacgc

SEQ ID NO: 2686 - DNA, 10 bp, Artificial Sequence
  intronic recognition element for splicing modifier (REMS)
tggagtacgc

SEQ ID NO: 2687 - DNA, 10 bp, Artificial Sequence
  intronic recognition element for splicing modifier (REMS)
  misc_feature (2)..(2): n is a, c, g, or t
tngagtacgc

SEQ ID NO: 2688 - DNA, 10 bp, Artificial Sequence
  intronic recognition element for splicing modifier (REMS)
  misc_feature (1)..(1): n is a, c, g, or t
ntgagtacgc

SEQ ID NO: 2689 - DNA, 10 bp, Artificial Sequence
  intronic recognition element for splicing modifier (REMS)
atgagtacgc

SEQ ID NO: 2690 - DNA, 10 bp, Artificial Sequence
  intronic recognition element for splicing modifier (REMS)
ctgagtacgc

SEQ ID NO: 2691 - DNA, 10 bp, Artificial Sequence
  intronic recognition element for splicing modifier (REMS)
gtgagtacgc

SEQ ID NO: 2692 - DNA, 10 bp, Artificial Sequence
  intronic recognition element for splicing modifier (REMS)
ttgagtacgc

SEQ ID NO: 2693 - DNA, 10 bp, Artificial Sequence
  intronic recognition element for splicing modifier (REMS)
  misc_feature (2)..(2): n is a, c, g, or t
angagtaggc

SEQ ID NO: 2694 - DNA, 10 bp, Artificial Sequence
  intronic recognition element for splicing modifier (REMS)
  misc_feature (1)..(1): n is a, c, g, or t
nagagtaggc

SEQ ID NO: 2695 - DNA, 10 bp, Artificial Sequence
  intronic recognition element for splicing modifier (REMS)
aagagtaggc

SEQ ID NO: 2696 - DNA, 10 bp, Artificial Sequence
  intronic recognition element for splicing modifier (REMS)
cagagtaggc

SEQ ID NO: 2697 - DNA, 10 bp, Artificial Sequence
  intronic recognition element for splicing modifier (REMS)
gagagtaggc

SEQ ID NO: 2698 - DNA, 10 bp, Artificial Sequence
  intronic recognition element for splicing modifier (REMS)
tagagtaggc

SEQ ID NO: 2699 - DNA, 10 bp, Artificial Sequence
  intronic recognition element for splicing modifier (REMS)
  misc_feature (2)..(2): n is a, c, g, or t
cngagtaggc

SEQ ID NO: 2700 - DNA, 10 bp, Artificial Sequence
  intronic recognition element for splicing modifier (REMS)
  misc_feature (1)..(1): n is a, c, g, or t
ncgagtaggc

SEQ ID NO: 2701 - DNA, 10 bp, Artificial Sequence
  intronic recognition element for splicing modifier (REMS)
acgagtaggc

SEQ ID NO: 2702 - DNA, 10 bp, Artificial Sequence
  intronic recognition element for splicing modifier (REMS)
ccgagtaggc

SEQ ID NO: 2703 - DNA, 10 bp, Artificial Sequence
  intronic recognition element for splicing modifier (REMS)
gcgagtaggc

SEQ ID NO: 2704 - DNA, 10 bp, Artificial Sequence
  intronic recognition element for splicing modifier (REMS)
tcgagtaggc

SEQ ID NO: 2705 - DNA, 10 bp, Artificial Sequence
  intronic recognition element for splicing modifier (REMS)
  misc_feature (2)..(2): n is a, c, g, or t
gngagtaggc

SEQ ID NO: 2706 - DNA, 10 bp, Artificial Sequence
  intronic recognition element for splicing modifier (REMS)
  misc_feature (1)..(1): n is a, c, g, or t
nggagtaggc

SEQ ID NO: 2707 - DNA, 10 bp, Artificial Sequence
  intronic recognition element for splicing modifier (REMS)
aggagtaggc

SEQ ID NO: 2708 - DNA, 10 bp, Artificial Sequence
  intronic recognition element for splicing modifier (REMS)
cggagtaggc

SEQ ID NO: 2709 - DNA, 10 bp, Artificial Sequence
  intronic recognition element for splicing modifier (REMS)
gggagtaggc

SEQ ID NO: 2710 - DNA, 10 bp, Artificial Sequence
  intronic recognition element for splicing modifier (REMS)
tggagtaggc

SEQ ID NO: 2711 - DNA, 10 bp, Artificial Sequence
  intronic recognition element for splicing modifier (REMS)
  misc_feature (2)..(2): n is a, c, g, or t
tngagtaggc

SEQ ID NO: 2712 - DNA, 10 bp, Artificial Sequence
  intronic recognition element for splicing modifier (REMS)
  misc_feature (1)..(1): n is a, c, g, or t
ntgagtaggc

SEQ ID NO: 2713 - DNA, 10 bp, Artificial Sequence
  intronic recognition element for splicing modifier (REMS)
atgagtaggc

SEQ ID NO: 2714 - DNA, 10 bp, Artificial Sequence
  intronic recognition element for splicing modifier (REMS)
ctgagtaggc

SEQ ID NO: 2715 - DNA, 10 bp, Artificial Sequence
  intronic recognition element for splicing modifier (REMS)
gtgagtaggc

SEQ ID NO: 2716 - DNA, 10 bp, Artificial Sequence
  intronic recognition element for splicing modifier (REMS)
ttgagtaggc

SEQ ID NO: 2717 - DNA, 10 bp, Artificial Sequence
  intronic recognition element for splicing modifier (REMS)
  misc_feature (2)..(2): n is a, c, g, or t
angagtatgc

SEQ ID NO: 2718 - DNA, 10 bp, Artificial Sequence
  intronic recognition element for splicing modifier (REMS)
  misc_feature (1)..(1): n is a, c, g, or t
nagagtatgc

SEQ ID NO: 2719 - DNA, 10 bp, Artificial Sequence
  intronic recognition element for splicing modifier (REMS)
aagagtatgc

SEQ ID NO: 2720 - DNA, 10 bp, Artificial Sequence
  intronic recognition element for splicing modifier (REMS)
cagagtatgc

SEQ ID NO: 2721 - DNA, 10 bp, Artificial Sequence
  intronic recognition element for splicing modifier (REMS)
gagagtatgc

SEQ ID NO: 2722 - DNA, 10 bp, Artificial Sequence
  intronic recognition element for splicing modifier (REMS)
tagagtatgc

SEQ ID NO: 2723 - DNA, 10 bp, Artificial Sequence
  intronic recognition element for splicing modifier (REMS)
  misc_feature (2)..(2): n is a, c, g, or t
cngagtatgc

SEQ ID NO: 2724 - DNA, 10 bp, Artificial Sequence
  intronic recognition element for splicing modifier (REMS)
  misc_feature (1)..(1): n is a, c, g, or t
ncgagtatgc

SEQ ID NO: 2725 - DNA, 10 bp, Artificial Sequence
  intronic recognition element for splicing modifier (REMS)
acgagtatgc

SEQ ID NO: 2726 - DNA, 10 bp, Artificial Sequence
  intronic recognition element for splicing modifier (REMS)
ccgagtatgc

SEQ ID NO: 2727 - DNA, 10 bp, Artificial Sequence
  intronic recognition element for splicing modifier (REMS)
gcgagtatgc

SEQ ID NO: 2728 - DNA, 10 bp, Artificial Sequence
  intronic recognition element for splicing modifier (REMS)
tcgagtatgc

SEQ ID NO: 2729 - DNA, 10 bp, Artificial Sequence
  intronic recognition element for splicing modifier (REMS)
  misc_feature (2)..(2): n is a, c, g, or t
gngagtatgc

SEQ ID NO: 2730 - DNA, 10 bp, Artificial Sequence
  intronic recognition element for splicing modifier (REMS)
  misc_feature (1)..(1): n is a, c, g, or t
nggagtatgc

SEQ ID NO: 2731 - DNA, 10 bp, Artificial Sequence
  intronic recognition element for splicing modifier (REMS)
aggagtatgc

SEQ ID NO: 2732 - DNA, 10 bp, Artificial Sequence
  intronic recognition element for splicing modifier (REMS)
cggagtatgc

SEQ ID NO: 2733 - DNA, 10 bp, Artificial Sequence
  intronic recognition element for splicing modifier (REMS)
gggagtatgc

SEQ ID NO: 2734 - DNA, 10 bp, Artificial Sequence
  intronic recognition element for splicing modifier (REMS)
tggagtatgc

SEQ ID NO: 2735 - DNA, 10 bp, Artificial Sequence
  intronic recognition element for splicing modifier (REMS)
  misc_feature (2)..(2): n is a, c, g, or t
tngagtatgc

SEQ ID NO: 2736 - DNA, 10 bp, Artificial Sequence
  intronic recognition element for splicing modifier (REMS)
  misc_feature (1)..(1): n is a, c, g, or t
ntgagtatgc

SEQ ID NO: 2737 - DNA, 10 bp, Artificial Sequence
  intronic recognition element for splicing modifier (REMS)
atgagtatgc

SEQ ID NO: 2738 - DNA, 10 bp, Artificial Sequence
  intronic recognition element for splicing modifier (REMS)
ctgagtatgc

SEQ ID NO: 2739 - DNA, 10 bp, Artificial Sequence
  intronic recognition element for splicing modifier (REMS)
gtgagtatgc

SEQ ID NO: 2740 - DNA, 10 bp, Artificial Sequence
  intronic recognition element for splicing modifier (REMS)
ttgagtatgc

SEQ ID NO: 2741 - DNA, 10 bp, Artificial Sequence
  intronic recognition element for splicing modifier (REMS)
  misc_feature (2)..(2): n is a, c, g, or t
angagtaagg

SEQ ID NO: 2742 - DNA, 10 bp, Artificial Sequence
  intronic recognition element for splicing modifier (REMS)
  misc_feature (1)..(1): n is a, c, g, or t
nagagtaagg

SEQ ID NO: 2743 - DNA, 10 bp, Artificial Sequence
  intronic recognition element for splicing modifier (REMS)
aagagtaagg

SEQ ID NO: 2744 - DNA, 10 bp, Artificial Sequence
  intronic recognition element for splicing modifier (REMS)
cagagtaagg

SEQ ID NO: 2745 - DNA, 10 bp, Artificial Sequence
  intronic recognition element for splicing modifier (REMS)
gagagtaagg

SEQ ID NO: 2746 - DNA, 10 bp, Artificial Sequence
  intronic recognition element for splicing modifier (REMS)
tagagtaagg

SEQ ID NO: 2747 - DNA, 10 bp, Artificial Sequence
  intronic recognition element for splicing modifier (REMS)
  misc_feature (2)..(2): n is a, c, g, or t
cngagtaagg

SEQ ID NO: 2748 - DNA, 10 bp, Artificial Sequence
  intronic recognition element for splicing modifier (REMS)
  misc_feature (1)..(1): n is a, c, g, or t
ncgagtaagg

SEQ ID NO: 2749 - DNA, 10 bp, Artificial Sequence
  intronic recognition element for splicing modifier (REMS)
acgagtaagg

SEQ ID NO: 2750 - DNA, 10 bp, Artificial Sequence
  intronic recognition element for splicing modifier (REMS)
ccgagtaagg

SEQ ID NO: 2751 - DNA, 10 bp, Artificial Sequence
  intronic recognition element for splicing modifier (REMS)
gcgagtaagg

SEQ ID NO: 2752 - DNA, 10 bp, Artificial Sequence
  intronic recognition element for splicing modifier (REMS)
tcgagtaagg

SEQ ID NO: 2753 - DNA, 10 bp, Artificial Sequence
  intronic recognition element for splicing modifier (REMS)
  misc_feature (2)..(2): n is a, c, g, or t
gngagtaagg

SEQ ID NO: 2754 - DNA, 10 bp, Artificial Sequence
  intronic recognition element for splicing modifier (REMS)
  misc_feature (1)..(1): n is a, c, g, or t
nggagtaagg

SEQ ID NO: 2755 - DNA, 10 bp, Artificial Sequence
  intronic recognition element for splicing modifier (REMS)
aggagtaagg

SEQ ID NO: 2756 - DNA, 10 bp, Artificial Sequence
  intronic recognition element for splicing modifier (REMS)
cggagtaagg

SEQ ID NO: 2757 - DNA, 10 bp, Artificial Sequence
  intronic recognition element for splicing modifier (REMS)
gggagtaagg

SEQ ID NO: 2758 - DNA, 10 bp, Artificial Sequence
  intronic recognition element for splicing modifier (REMS)
tggagtaagg

SEQ ID NO: 2759 - DNA, 10 bp, Artificial Sequence
  intronic recognition element for splicing modifier (REMS)
  misc_feature (2)..(2): n is a, c, g, or t
tngagtaagg

SEQ ID NO: 2760 - DNA, 10 bp, Artificial Sequence
  intronic recognition element for splicing modifier (REMS)
  misc_feature (1)..(1): n is a, c, g, or t
ntgagtaagg

SEQ ID NO: 2761 - DNA, 10 bp, Artificial Sequence
  intronic recognition element for splicing modifier (REMS)
atgagtaagg

SEQ ID NO: 2762 - DNA, 10 bp, Artificial Sequence
  intronic recognition element for splicing modifier (REMS)
ctgagtaagg

SEQ ID NO: 2763 - DNA, 10 bp, Artificial Sequence
  intronic recognition element for splicing modifier (REMS)
gtgagtaagg

SEQ ID NO: 2764 - DNA, 10 bp, Artificial Sequence
  intronic recognition element for splicing modifier (REMS)
ttgagtaagg

SEQ ID NO: 2765 - DNA, 10 bp, Artificial Sequence
  intronic recognition element for splicing modifier (REMS)
  misc_feature (2)..(2): n is a, c, g, or t
angagtacgg

SEQ ID NO: 2766 - DNA, 10 bp, Artificial Sequence
  intronic recognition element for splicing modifier (REMS)
  misc_feature (1)..(1): n is a, c, g, or t
nagagtacgg

SEQ ID NO: 2767 - DNA, 10 bp, Artificial Sequence
  intronic recognition element for splicing modifier (REMS)
aagagtacgg

SEQ ID NO: 2768 - DNA, 10 bp, Artificial Sequence
  intronic recognition element for splicing modifier (REMS)
cagagtacgg

SEQ ID NO: 2769 - DNA, 10 bp, Artificial Sequence
  intronic recognition element for splicing modifier (REMS)
gagagtacgg

SEQ ID NO: 2770 - DNA, 10 bp, Artificial Sequence
  intronic recognition element for splicing modifier (REMS)
tagagtacgg

SEQ ID NO: 2771 - DNA, 10 bp, Artificial Sequence
  intronic recognition element for splicing modifier (REMS)
  misc_feature (2)..(2): n is a, c, g, or t
cngagtacgg

SEQ ID NO: 2772 - DNA, 10 bp, Artificial Sequence
  intronic recognition element for splicing modifier (REMS)
  misc_feature (1)..(1): n is a, c, g, or t
ncgagtacgg

SEQ ID NO: 2773 - DNA, 10 bp, Artificial Sequence
  intronic recognition element for splicing modifier (REMS)
acgagtacgg

SEQ ID NO: 2774 - DNA, 10 bp, Artificial Sequence
  intronic recognition element for splicing modifier (REMS)
ccgagtacgg

SEQ ID NO: 2775 - DNA, 10 bp, Artificial Sequence
  intronic recognition element for splicing modifier (REMS)
gcgagtacgg

SEQ ID NO: 2776 - DNA, 10 bp, Artificial Sequence
  intronic recognition element for splicing modifier (REMS)
tcgagtacgg

SEQ ID NO: 2777 - DNA, 10 bp, Artificial Sequence
  intronic recognition element for splicing modifier (REMS)
  misc_feature (2)..(2): n is a, c, g, or t
gngagtacgg

SEQ ID NO: 2778 - DNA, 10 bp, Artificial Sequence
  intronic recognition element for splicing modifier (REMS)
  misc_feature (1)..(1): n is a, c, g, or t
nggagtacgg

SEQ ID NO: 2779 - DNA, 10 bp, Artificial Sequence
  intronic recognition element for splicing modifier (REMS)
aggagtacgg

SEQ ID NO: 2780 - DNA, 10 bp, Artificial Sequence
  intronic recognition element for splicing modifier (REMS)
cggagtacgg

SEQ ID NO: 2781 - DNA, 10 bp, Artificial Sequence
  intronic recognition element for splicing modifier (REMS)
gggagtacgg

SEQ ID NO: 2782 - DNA, 10 bp, Artificial Sequence
  intronic recognition element for splicing modifier (REMS)
tggagtacgg

SEQ ID NO: 2783 - DNA, 10 bp, Artificial Sequence
  intronic recognition element for splicing modifier (REMS)
  misc_feature (2)..(2): n is a, c, g, or t
tngagtacgg

SEQ ID NO: 2784 - DNA, 10 bp, Artificial Sequence
  intronic recognition element for splicing modifier (REMS)
  misc_feature (1)..(1): n is a, c, g, or t
ntgagtacgg

SEQ ID NO: 2785 - DNA, 10 bp, Artificial Sequence
  intronic recognition element for splicing modifier (REMS)
atgagtacgg

SEQ ID NO: 2786 - DNA, 10 bp, Artificial Sequence
  intronic recognition element for splicing modifier (REMS)
ctgagtacgg

SEQ ID NO: 2787 - DNA, 10 bp, Artificial Sequence
  intronic recognition element for splicing modifier (REMS)
gtgagtacgg

SEQ ID NO: 2788 - DNA, 10 bp, Artificial Sequence
  intronic recognition element for splicing modifier (REMS)
ttgagtacgg

SEQ ID NO: 2789 - DNA, 10 bp, Artificial Sequence
  intronic recognition element for splicing modifier (REMS)
  misc_feature (2)..(2): n is a, c, g, or t
angagtaggg

SEQ ID NO: 2790 - DNA, 10 bp, Artificial Sequence
  intronic recognition element for splicing modifier (REMS)
  misc_feature (1)..(1): n is a, c, g, or t
nagagtaggg

SEQ ID NO: 2791 - DNA, 10 bp, Artificial Sequence
  intronic recognition element for splicing modifier (REMS)
aagagtaggg

SEQ ID NO: 2792 - DNA, 10 bp, Artificial Sequence
  intronic recognition element for splicing modifier (REMS)
cagagtaggg

SEQ ID NO: 2793 - DNA, 10 bp, Artificial Sequence
  intronic recognition element for splicing modifier (REMS)
gagagtaggg

SEQ ID NO: 2794 - DNA, 10 bp, Artificial Sequence
  intronic recognition element for splicing modifier (REMS)
tagagtaggg

SEQ ID NO: 2795 - DNA, 10 bp, Artificial Sequence
  intronic recognition element for splicing modifier (REMS)
  misc_feature (2)..(2): n is a, c, g, or t
cngagtaggg

SEQ ID NO: 2796 - DNA, 10 bp, Artificial Sequence
  intronic recognition element for splicing modifier (REMS)
  misc_feature (1)..(1): n is a, c, g, or t
ncgagtaggg

SEQ ID NO: 2797 - DNA, 10 bp, Artificial Sequence
  intronic recognition element for splicing modifier (REMS)
acgagtaggg

SEQ ID NO: 2798 - DNA, 10 bp, Artificial Sequence
  intronic recognition element for splicing modifier (REMS)
ccgagtaggg

SEQ ID NO: 2799 - DNA, 10 bp, Artificial Sequence
  intronic recognition element for splicing modifier (REMS)
gcgagtaggg

SEQ ID NO: 2800 - DNA, 10 bp, Artificial Sequence
  intronic recognition element for splicing modifier (REMS)
tcgagtaggg

SEQ ID NO: 2801 - DNA, 10 bp, Artificial Sequence
  intronic recognition element for splicing modifier (REMS)
  misc_feature (2)..(2): n is a, c, g, or t
gngagtaggg

SEQ ID NO: 2802 - DNA, 10 bp, Artificial Sequence
  intronic recognition element for splicing modifier (REMS)
  misc_feature (1)..(1): n is a, c, g, or t
nggagtaggg

SEQ ID NO: 2803 - DNA, 10 bp, Artificial Sequence
  intronic recognition element for splicing modifier (REMS)
aggagtaggg

SEQ ID NO: 2804 - DNA, 10 bp, Artificial Sequence
  intronic recognition element for splicing modifier (REMS)
cggagtaggg

SEQ ID NO: 2805 - DNA, 10 bp, Artificial Sequence
  intronic recognition element for splicing modifier (REMS)
gggagtaggg

SEQ ID NO: 2806 - DNA, 10 bp, Artificial Sequence
  intronic recognition element for splicing modifier (REMS)
tggagtaggg

SEQ ID NO: 2807 - DNA, 10 bp, Artificial Sequence
  intronic recognition element for splicing modifier (REMS)
  misc_feature (2)..(2): n is a, c, g, or t
tngagtaggg

SEQ ID NO: 2808 - DNA, 10 bp, Artificial Sequence
  intronic recognition element for splicing modifier (REMS)
  misc_feature (1)..(1): n is a, c, g, or t
ntgagtaggg

SEQ ID NO: 2809 - DNA, 10 bp, Artificial Sequence
  intronic recognition element for splicing modifier (REMS)
atgagtaggg

SEQ ID NO: 2810 - DNA, 10 bp, Artificial Sequence
  intronic recognition element for splicing modifier (REMS)
ctgagtaggg

SEQ ID NO: 2811 - DNA, 10 bp, Artificial Sequence
  intronic recognition element for splicing modifier (REMS)
gtgagtaggg

SEQ ID NO: 2812 - DNA, 10 bp, Artificial Sequence
  intronic recognition element for splicing modifier (REMS)
ttgagtaggg

SEQ ID NO: 2813 - DNA, 10 bp, Artificial Sequence
  intronic recognition element for splicing modifier (REMS)
  misc_feature (2)..(2): n is a, c, g, or t
angagtatgg

SEQ ID NO: 2814 - DNA, 10 bp, Artificial Sequence
  intronic recognition element for splicing modifier (REMS)
  misc_feature (1)..(1): n is a, c, g, or t
nagagtatgg

SEQ ID NO: 2815 - DNA, 10 bp, Artificial Sequence
  intronic recognition element for splicing modifier (REMS)
aagagtatgg

SEQ ID NO: 2816 - DNA, 10 bp, Artificial Sequence
  intronic recognition element for splicing modifier (REMS)
cagagtatgg

SEQ ID NO: 2817 - DNA, 10 bp, Artificial Sequence
  intronic recognition element for splicing modifier (REMS)
gagagtatgg

SEQ ID NO: 2818 - DNA, 10 bp, Artificial Sequence
  intronic recognition element for splicing modifier (REMS)
tagagtatgg

SEQ ID NO: 2819 - DNA, 10 bp, Artificial Sequence
  intronic recognition element for splicing modifier (REMS)
  misc_feature (2)..(2): n is a, c, g, or t
cngagtatgg

SEQ ID NO: 2820 - DNA, 10 bp, Artificial Sequence
  intronic recognition element for splicing modifier (REMS)
  misc_feature (1)..(1): n is a, c, g, or t
ncgagtatgg

SEQ ID NO: 2821 - DNA, 10 bp, Artificial Sequence
  intronic recognition element for splicing modifier (REMS)
acgagtatgg

SEQ ID NO: 2822 - DNA, 10 bp, Artificial Sequence
  intronic recognition element for splicing modifier (REMS)
ccgagtatgg

SEQ ID NO: 2823 - DNA, 10 bp, Artificial Sequence
  intronic recognition element for splicing modifier (REMS)
gcgagtatgg

SEQ ID NO: 2824 - DNA, 10 bp, Artificial Sequence
  intronic recognition element for splicing modifier (REMS)
tcgagtatgg

SEQ ID NO: 2825 - DNA, 10 bp, Artificial Sequence
  intronic recognition element for splicing modifier (REMS)
  misc_feature (2)..(2): n is a, c, g, or t
gngagtatgg

SEQ ID NO: 2826 - DNA, 10 bp, Artificial Sequence
  intronic recognition element for splicing modifier (REMS)
  misc_feature (1)..(1): n is a, c, g, or t
nggagtatgg

SEQ ID NO: 2827 - DNA, 10 bp, Artificial Sequence
  intronic recognition element for splicing modifier (REMS)
aggagtatgg

SEQ ID NO: 2828 - DNA, 10 bp, Artificial Sequence
  intronic recognition element for splicing modifier (REMS)
cggagtatgg

SEQ ID NO: 2829 - DNA, 10 bp, Artificial Sequence
  intronic recognition element for splicing modifier (REMS)
gggagtatgg

SEQ ID NO: 2830 - DNA, 10 bp, Artificial Sequence
  intronic recognition element for splicing modifier (REMS)
tggagtatgg

SEQ ID NO: 2831 - DNA, 10 bp, Artificial Sequence
  intronic recognition element for splicing modifier (REMS)
  misc_feature (2)..(2): n is a, c, g, or t
tngagtatgg

SEQ ID NO: 2832 - DNA, 10 bp, Artificial Sequence
  intronic recognition element for splicing modifier (REMS)
  misc_feature (1)..(1): n is a, c, g, or t
ntgagtatgg

SEQ ID NO: 2833 - DNA, 10 bp, Artificial Sequence
  intronic recognition element for splicing modifier (REMS)
atgagtatgg

SEQ ID NO: 2834 - DNA, 10 bp, Artificial Sequence
  intronic recognition element for splicing modifier (REMS)
ctgagtatgg

SEQ ID NO: 2835 - DNA, 10 bp, Artificial Sequence
  intronic recognition element for splicing modifier (REMS)
gtgagtatgg

SEQ ID NO: 2836 - DNA, 10 bp, Artificial Sequence
  intronic recognition element for splicing modifier (REMS)
ttgagtatgg

SEQ ID NO: 2837 - DNA, 10 bp, Artificial Sequence
  intronic recognition element for splicing modifier (REMS)
  misc_feature (2)..(2): n is a, c, g, or t
angagtaagt

SEQ ID NO: 2838 - DNA, 10 bp, Artificial Sequence
  intronic recognition element for splicing modifier (REMS)
  misc_feature (1)..(1): n is a, c, g, or t
nagagtaagt

SEQ ID NO: 2839 - DNA, 10 bp, Artificial Sequence
  intronic recognition element for splicing modifier (REMS)
aagagtaagt

SEQ ID NO: 2840 - DNA, 10 bp, Artificial Sequence
  intronic recognition element for splicing modifier (REMS)
cagagtaagt

SEQ ID NO: 2841 - DNA, 10 bp, Artificial Sequence
  intronic recognition element for splicing modifier (REMS)
gagagtaagt

SEQ ID NO: 2842 - DNA, 10 bp, Artificial Sequence
  intronic recognition element for splicing modifier (REMS)
tagagtaagt

SEQ ID NO: 2843 - DNA, 10 bp, Artificial Sequence
  intronic recognition element for splicing modifier (REMS)
  misc_feature (2)..(2): n is a, c, g, or t
cngagtaagt

SEQ ID NO: 2844 - DNA, 10 bp, Artificial Sequence
  intronic recognition element for splicing modifier (REMS)
  misc_feature (1)..(1): n is a, c, g, or t
ncgagtaagt

SEQ ID NO: 2845 - DNA, 10 bp, Artificial Sequence
  intronic recognition element for splicing modifier (REMS)
acgagtaagt

SEQ ID NO: 2846 - DNA, 10 bp, Artificial Sequence
  intronic recognition element for splicing modifier (REMS)
ccgagtaagt

SEQ ID NO: 2847 - DNA, 10 bp, Artificial Sequence
  intronic recognition element for splicing modifier (REMS)
gcgagtaagt

SEQ ID NO: 2848 - DNA, 10 bp, Artificial Sequence
  intronic recognition element for splicing modifier (REMS)
tcgagtaagt

SEQ ID NO: 2849 - DNA, 10 bp, Artificial Sequence
  intronic recognition element for splicing modifier (REMS)
  misc_feature (2)..(2): n is a, c, g, or t
gngagtaagt

SEQ ID NO: 2850 - DNA, 10 bp, Artificial Sequence
  intronic recognition element for splicing modifier (REMS)
  misc_feature (1)..(1): n is a, c, g, or t
nggagtaagt

SEQ ID NO: 2851 - DNA, 10 bp, Artificial Sequence
  intronic recognition element for splicing modifier (REMS)
aggagtaagt

SEQ ID NO: 2852 - DNA, 10 bp, Artificial Sequence
  intronic recognition element for splicing modifier (REMS)
cggagtaagt

SEQ ID NO: 2853 - DNA, 10 bp, Artificial Sequence
  intronic recognition element for splicing modifier (REMS)
gggagtaagt

SEQ ID NO: 2854 - DNA, 10 bp, Artificial Sequence
  intronic recognition element for splicing modifier (REMS)
tggagtaagt

SEQ ID NO: 2855 - DNA, 10 bp, Artificial Sequence
  intronic recognition element for splicing modifier (REMS)
  misc_feature (2)..(2): n is a, c, g, or t
tngagtaagt

SEQ ID NO: 2856 - DNA, 10 bp, Artificial Sequence
  intronic recognition element for splicing modifier (REMS)
  misc_feature (1)..(1): n is a, c, g, or t
ntgagtaagt

SEQ ID NO: 2857 - DNA, 10 bp, Artificial Sequence
  intronic recognition element for splicing modifier (REMS)
atgagtaagt

SEQ ID NO: 2858 - DNA, 10 bp, Artificial Sequence
  intronic recognition element for splicing modifier (REMS)
ctgagtaagt

SEQ ID NO: 2859 - DNA, 10 bp, Artificial Sequence
  intronic recognition element for splicing modifier (REMS)
gtgagtaagt

SEQ ID NO: 2860 - DNA, 10 bp, Artificial Sequence
  intronic recognition element for splicing modifier (REMS)
ttgagtaagt

SEQ ID NO: 2861 - DNA, 10 bp, Artificial Sequence
  intronic recognition element for splicing modifier (REMS)
  misc_feature (2)..(2): n is a, c, g, or t
angagtacgt

SEQ ID NO: 2862 - DNA, 10 bp, Artificial Sequence
  intronic recognition element for splicing modifier (REMS)
  misc_feature (1)..(1): n is a, c, g, or t
nagagtacgt

SEQ ID NO: 2863 - DNA, 10 bp, Artificial Sequence
  intronic recognition element for splicing modifier (REMS)
aagagtacgt

SEQ ID NO: 2864 - DNA, 10 bp, Artificial Sequence
  intronic recognition element for splicing modifier (REMS)
cagagtacgt

SEQ ID NO: 2865 - DNA, 10 bp, Artificial Sequence
  intronic recognition element for splicing modifier (REMS)
gagagtacgt

SEQ ID NO: 2866 - DNA, 10 bp, Artificial Sequence
  intronic recognition element for splicing modifier (REMS)
tagagtacgt

SEQ ID NO: 2867 - DNA, 10 bp, Artificial Sequence
  intronic recognition element for splicing modifier (REMS)
  misc_feature (2)..(2): n is a, c, g, or t
cngagtacgt

SEQ ID NO: 2868 - DNA, 10 bp, Artificial Sequence
  intronic recognition element for splicing modifier (REMS)
  misc_feature (1)..(1): n is a, c, g, or t
ncgagtacgt

SEQ ID NO: 2869 - DNA, 10 bp, Artificial Sequence
  intronic recognition element for splicing modifier (REMS)
acgagtacgt

SEQ ID NO: 2870 - DNA, 10 bp, Artificial Sequence
  intronic recognition element for splicing modifier (REMS)
ccgagtacgt

SEQ ID NO: 2871 - DNA, 10 bp, Artificial Sequence
  intronic recognition element for splicing modifier (REMS)
gcgagtacgt

SEQ ID NO: 2872 - DNA, 10 bp, Artificial Sequence
  intronic recognition element for splicing modifier (REMS)
tcgagtacgt

SEQ ID NO: 2873 - DNA, 10 bp, Artificial Sequence
  intronic recognition element for splicing modifier (REMS)
  misc_feature (2)..(2): n is a, c, g, or t
gngagtacgt

SEQ ID NO: 2874 - DNA, 10 bp, Artificial Sequence
  intronic recognition element for splicing modifier (REMS)
  misc_feature (1)..(1): n is a, c, g, or t
nggagtacgt

SEQ ID NO: 2875 - DNA, 10 bp, Artificial Sequence
  intronic recognition element for splicing modifier (REMS)
aggagtacgt

SEQ ID NO: 2876 - DNA, 10 bp, Artificial Sequence
  intronic recognition element for splicing modifier (REMS)
cggagtacgt

SEQ ID NO: 2877 - DNA, 10 bp, Artificial Sequence
  intronic recognition element for splicing modifier (REMS)
gggagtacgt

SEQ ID NO: 2878 - DNA, 10 bp, Artificial Sequence
  intronic recognition element for splicing modifier (REMS)
tggagtacgt

SEQ ID NO: 2879 - DNA, 10 bp, Artificial Sequence
  intronic recognition element for splicing modifier (REMS)
  misc_feature (2)..(2): n is a, c, g, or t
tngagtacgt

SEQ ID NO: 2880 - DNA, 10 bp, Artificial Sequence
  intronic recognition element for splicing modifier (REMS)
  misc_feature (1)..(1): n is a, c, g, or t
ntgagtacgt

SEQ ID NO: 2881 - DNA, 10 bp, Artificial Sequence
  intronic recognition element for splicing modifier (REMS)
atgagtacgt

SEQ ID NO: 2882 - DNA, 10 bp, Artificial Sequence
  intronic recognition element for splicing modifier (REMS)
ctgagtacgt

SEQ ID NO: 2883 - DNA, 10 bp, Artificial Sequence
  intronic recognition element for splicing modifier (REMS)
gtgagtacgt

SEQ ID NO: 2884 - DNA, 10 bp, Artificial Sequence
  intronic recognition element for splicing modifier (REMS)
ttgagtacgt

SEQ ID NO: 2885 - DNA, 10 bp, Artificial Sequence
  intronic recognition element for splicing modifier (REMS)
  misc_feature (2)..(2): n is a, c, g, or t
angagtaggt

SEQ ID NO: 2886 - DNA, 10 bp, Artificial Sequence
  intronic recognition element for splicing modifier (REMS)
  misc_feature (1)..(1): n is a, c, g, or t
nagagtaggt

SEQ ID NO: 2887 - DNA, 10 bp, Artificial Sequence
  intronic recognition element for splicing modifier (REMS)
aagagtaggt

SEQ ID NO: 2888 - DNA, 10 bp, Artificial Sequence
  intronic recognition element for splicing modifier (REMS)
cagagtaggt

SEQ ID NO: 2889 - DNA, 10 bp, Artificial Sequence
  intronic recognition element for splicing modifier (REMS)
gagagtaggt

SEQ ID NO: 2890 - DNA, 10 bp, Artificial Sequence
  intronic recognition element for splicing modifier (REMS)
tagagtaggt

SEQ ID NO: 2891 - DNA, 10 bp, Artificial Sequence
  intronic recognition element for splicing modifier (REMS)
  misc_feature (2)..(2): n is a, c, g, or t
cngagtaggt

SEQ ID NO: 2892 - DNA, 10 bp, Artificial Sequence
  intronic recognition element for splicing modifier (REMS)
  misc_feature (1)..(1): n is a, c, g, or t
ncgagtaggt

SEQ ID NO: 2893 - DNA, 10 bp, Artificial Sequence
  intronic recognition element for splicing modifier (REMS)
acgagtaggt

SEQ ID NO: 2894 - DNA, 10 bp, Artificial Sequence
  intronic recognition element for splicing modifier (REMS)
ccgagtaggt

SEQ ID NO: 2895 - DNA, 10 bp, Artificial Sequence
  intronic recognition element for splicing modifier (REMS)
gcgagtaggt

SEQ ID NO: 2896 - DNA, 10 bp, Artificial Sequence
  intronic recognition element for splicing modifier (REMS)
tcgagtaggt

SEQ ID NO: 2897 - DNA, 10 bp, Artificial Sequence
  intronic recognition element for splicing modifier (REMS)
  misc_feature (2)..(2): n is a, c, g, or t
gngagtaggt

SEQ ID NO: 2898 - DNA, 10 bp, Artificial Sequence
  intronic recognition element for splicing modifier (REMS)
  misc_feature (1)..(1): n is a, c, g, or t
nggagtaggt

SEQ ID NO: 2899 - DNA, 10 bp, Artificial Sequence
  intronic recognition element for splicing modifier (REMS)
aggagtaggt

SEQ ID NO: 2900 - DNA, 10 bp, Artificial Sequence
  intronic recognition element for splicing modifier (REMS)
cggagtaggt

SEQ ID NO: 2901 - DNA, 10 bp, Artificial Sequence
  intronic recognition element for splicing modifier (REMS)
gggagtaggt

SEQ ID NO: 2902 - DNA, 10 bp, Artificial Sequence
  intronic recognition element for splicing modifier (REMS)
tggagtaggt

SEQ ID NO: 2903 - DNA, 10 bp, Artificial Sequence
  intronic recognition element for splicing modifier (REMS)
  misc_feature (2)..(2): n is a, c, g, or t
tngagtaggt

SEQ ID NO: 2904 - DNA, 10 bp, Artificial Sequence
  intronic recognition element for splicing modifier (REMS)
  misc_feature (1)..(1): n is a, c, g, or t
ntgagtaggt

SEQ ID NO: 2905 - DNA, 10 bp, Artificial Sequence
  intronic recognition element for splicing modifier (REMS)
atgagtaggt

SEQ ID NO: 2906 - DNA, 10 bp, Artificial Sequence
  intronic recognition element for splicing modifier (REMS)
ctgagtaggt

SEQ ID NO: 2907 - DNA, 10 bp, Artificial Sequence
  intronic recognition element for splicing modifier (REMS)
gtgagtaggt

SEQ ID NO: 2908 - DNA, 10 bp, Artificial Sequence
  intronic recognition element for splicing modifier (REMS)
ttgagtaggt

SEQ ID NO: 2909 - DNA, 10 bp, Artificial Sequence
  intronic recognition element for splicing modifier (REMS)
  misc_feature (2)..(2): n is a, c, g, or t
angagtatgt

SEQ ID NO: 2910 - DNA, 10 bp, Artificial Sequence
  intronic recognition element for splicing modifier (REMS)
  misc_feature (1)..(1): n is a, c, g, or t
nagagtatgt

SEQ ID NO: 2911 - DNA, 10 bp, Artificial Sequence
  intronic recognition element for splicing modifier (REMS)
aagagtatgt

SEQ ID NO: 2912 - DNA, 10 bp, Artificial Sequence
  intronic recognition element for splicing modifier (REMS)
cagagtatgt

SEQ ID NO: 2913 - DNA, 10 bp, Artificial Sequence
  intronic recognition element for splicing modifier (REMS)
gagagtatgt

SEQ ID NO: 2914 - DNA, 10 bp, Artificial Sequence
  intronic recognition element for splicing modifier (REMS)
tagagtatgt

SEQ ID NO: 2915 - DNA, 10 bp, Artificial Sequence
  intronic recognition element for splicing modifier (REMS)
  misc_feature (2)..(2): n is a, c, g, or t
cngagtatgt

SEQ ID NO: 2916 - DNA, 10 bp, Artificial Sequence
  intronic recognition element for splicing modifier (REMS)
  misc_feature (1)..(1): n is a, c, g, or t
ncgagtatgt

SEQ ID NO: 2917 - DNA, 10 bp, Artificial Sequence
  intronic recognition element for splicing modifier (REMS)
acgagtatgt

SEQ ID NO: 2918 - DNA, 10 bp, Artificial Sequence
  intronic recognition element for splicing modifier (REMS)
ccgagtatgt

SEQ ID NO: 2919 - DNA, 10 bp, Artificial Sequence
  intronic recognition element for splicing modifier (REMS)
gcgagtatgt

SEQ ID NO: 2920 - DNA, 10 bp, Artificial Sequence
  intronic recognition element for splicing modifier (REMS)
tcgagtatgt

SEQ ID NO: 2921 - DNA, 10 bp, Artificial Sequence
  intronic recognition element for splicing modifier (REMS)
  misc_feature (2)..(2): n is a, c, g, or t
gngagtatgt

SEQ ID NO: 2922 - DNA, 10 bp, Artificial Sequence
  intronic recognition element for splicing modifier (REMS)
  misc_feature (1)..(1): n is a, c, g, or t
nggagtatgt

SEQ ID NO: 2923 - DNA, 10 bp, Artificial Sequence
  intronic recognition element for splicing modifier (REMS)
aggagtatgt

SEQ ID NO: 2924 - DNA, 10 bp, Artificial Sequence
  intronic recognition element for splicing modifier (REMS)
cggagtatgt

SEQ ID NO: 2925 - DNA, 10 bp, Artificial Sequence
  intronic recognition element for splicing modifier (REMS)
gggagtatgt

SEQ ID NO: 2926 - DNA, 10 bp, Artificial Sequence
  intronic recognition element for splicing modifier (REMS)
tggagtatgt

SEQ ID NO: 2927 - DNA, 10 bp, Artificial Sequence
  intronic recognition element for splicing modifier (REMS)
  misc_feature (2)..(2): n is a, c, g, or t
tngagtatgt

SEQ ID NO: 2928 - DNA, 10 bp, Artificial Sequence
  intronic recognition element for splicing modifier (REMS)
  misc_feature (1)..(1): n is a, c, g, or t
ntgagtatgt

SEQ ID NO: 2929 - DNA, 10 bp, Artificial Sequence
  intronic recognition element for splicing modifier (REMS)
atgagtatgt

SEQ ID NO: 2930 - DNA, 10 bp, Artificial Sequence
  intronic recognition element for splicing modifier (REMS)
ctgagtatgt

SEQ ID NO: 2931 - DNA, 10 bp, Artificial Sequence
  intronic recognition element for splicing modifier (REMS)
gtgagtatgt

SEQ ID NO: 2932 - DNA, 10 bp, Artificial Sequence
  intronic recognition element for splicing modifier (REMS)
ttgagtatgt

SEQ ID NO: 2933 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtanga

SEQ ID NO: 2934 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtanga

SEQ ID NO: 2935 - DNA, 10 bp, Artificial Sequence
  intronic recognition element for splicing modifier (REMS)
  misc_feature (8)..(8): n is a, c, g, or t
aagagtanga

SEQ ID NO: 2936 - DNA, 10 bp, Artificial Sequence
  intronic recognition element for splicing modifier (REMS)
  misc_feature (8)..(8): n is a, c, g, or t
cagagtanga

SEQ ID NO: 2937 - DNA, 10 bp, Artificial Sequence
  intronic recognition element for splicing modifier (REMS)
  misc_feature (8)..(8): n is a, c, g, or t
gagagtanga

SEQ ID NO: 2938 - DNA, 10 bp, Artificial Sequence
  intronic recognition element for splicing modifier (REMS)
  misc_feature (8)..(8): n is a, c, g, or t
tagagtanga

SEQ ID NO: 2939 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtanga

SEQ ID NO: 2940 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtanga

SEQ ID NO: 2941 - DNA, 10 bp, Artificial Sequence
  intronic recognition element for splicing modifier (REMS)
  misc_feature (8)..(8): n is a, c, g, or t
acgagtanga

SEQ ID NO: 2942 - DNA, 10 bp, Artificial Sequence
  intronic recognition element for splicing modifier (REMS)
  misc_feature (8)..(8): n is a, c, g, or t
ccgagtanga

SEQ ID NO: 2943 - DNA, 10 bp, Artificial Sequence
  intronic recognition element for splicing modifier (REMS)
  misc_feature (8)..(8): n is a, c, g, or t
gcgagtanga

SEQ ID NO: 2944 - DNA, 10 bp, Artificial Sequence
  intronic recognition element for splicing modifier (REMS)
  misc_feature (8)..(8): n is a, c, g, or t
tcgagtanga

SEQ ID NO: 2945 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtanga

SEQ ID NO: 2946 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtanga

SEQ ID NO: 2947 - DNA, 10 bp, Artificial Sequence
  intronic recognition element for splicing modifier (REMS)
  misc_feature (8)..(8): n is a, c, g, or t
aggagtanga

SEQ ID NO: 2948 - DNA, 10 bp, Artificial Sequence
  intronic recognition element for splicing modifier (REMS)
  misc_feature (8)..(8): n is a, c, g, or t
cggagtanga

SEQ ID NO: 2949 - DNA, 10 bp, Artificial Sequence
  intronic recognition element for splicing modifier (REMS)
  misc_feature (8)..(8): n is a, c, g, or t
gggagtanga

SEQ ID NO: 2950 - DNA, 10 bp, Artificial Sequence
  intronic recognition element for splicing modifier (REMS)
  misc_feature (8)..(8): n is a, c, g, or t
tggagtanga

SEQ ID NO: 2951 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtanga

SEQ ID NO: 2952 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtanga

SEQ ID NO: 2953 - DNA, 10 bp, Artificial Sequence
  intronic recognition element for splicing modifier (REMS)
  misc_feature (8)..(8): n is a, c, g, or t
atgagtanga

SEQ ID NO: 2954 - DNA, 10 bp, Artificial Sequence
  intronic recognition element for splicing modifier (REMS)
  misc_feature (8)..(8): n is a, c, g, or t
ctgagtanga

SEQ ID NO: 2955 - DNA, 10 bp, Artificial Sequence
  intronic recognition element for splicing modifier (REMS)
  misc_feature (8)..(8): n is a, c, g, or t
gtgagtanga

SEQ ID NO: 2956 - DNA, 10 bp, Artificial Sequence
  intronic recognition element for splicing modifier (REMS)
  misc_feature (8)..(8): n is a, c, g, or t
ttgagtanga

SEQ ID NO: 2957 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtangc

SEQ ID NO: 2958 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtangc

SEQ ID NO: 2959 - DNA, 10 bp, Artificial Sequence
  intronic recognition element for splicing modifier (REMS)
  misc_feature (8)..(8): n is a, c, g, or t
aagagtangc

SEQ ID NO: 2960 - DNA, 10 bp, Artificial Sequence
  intronic recognition element for splicing modifier (REMS)
  misc_feature (8)..(8): n is a, c, g, or t
cagagtangc

SEQ ID NO: 2961 - DNA, 10 bp, Artificial Sequence
  intronic recognition element for splicing modifier (REMS)
  misc_feature (8)..(8): n is a, c, g, or t
gagagtangc

SEQ ID NO: 2962 - DNA, 10 bp, Artificial Sequence
  intronic recognition element for splicing modifier (REMS)
  misc_feature (8)..(8): n is a, c, g, or t
tagagtangc

SEQ ID NO: 2963 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtangc

SEQ ID NO: 2964 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtangc

SEQ ID NO: 2965 - DNA, 10 bp, Artificial Sequence
  intronic recognition element for splicing modifier (REMS)
  misc_feature (8)..(8): n is a, c, g, or t
acgagtangc

SEQ ID NO: 2966 - DNA, 10 bp, Artificial Sequence
  intronic recognition element for splicing modifier (REMS)
  misc_feature (8)..(8): n is a, c, g, or t
ccgagtangc

SEQ ID NO: 2967 - DNA, 10 bp, Artificial Sequence
  intronic recognition element for splicing modifier (REMS)
  misc_feature (8)..(8): n is a, c, g, or t
gcgagtangc

SEQ ID NO: 2968 - DNA, 10 bp, Artificial Sequence
  intronic recognition element for splicing modifier (REMS)
  misc_feature (8)..(8): n is a, c, g, or t
tcgagtangc

SEQ ID NO: 2969 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtangc

SEQ ID NO: 2970 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtangc

SEQ ID NO: 2971 - DNA, 10 bp, Artificial Sequence
  intronic recognition element for splicing modifier (REMS)
  misc_feature (8)..(8): n is a, c, g, or t
aggagtangc

SEQ ID NO: 2972 - DNA, 10 bp, Artificial Sequence
  intronic recognition element for splicing modifier (REMS)
  misc_feature (8)..(8): n is a, c, g, or t
cggagtangc

SEQ ID NO: 2973 - DNA, 10 bp, Artificial Sequence
  intronic recognition element for splicing modifier (REMS)
  misc_feature (8)..(8): n is a, c, g, or t
gggagtangc

SEQ ID NO: 2974 - DNA, 10 bp, Artificial Sequence
  intronic recognition element for splicing modifier (REMS)
  misc_feature (8)..(8): n is a, c, g, or t
tggagtangc

SEQ ID NO: 2975 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtangc

SEQ ID NO: 2976 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtangc

SEQ ID NO: 2977 - DNA, 10 bp, Artificial Sequence
  intronic recognition element for splicing modifier (REMS)
  misc_feature (8)..(8): n is a, c, g, or t
atgagtangc

SEQ ID NO: 2978 - DNA, 10 bp, Artificial Sequence
  intronic recognition element for splicing modifier (REMS)
  misc_feature (8)..(8): n is a, c, g, or t
ctgagtangc

SEQ ID NO: 2979 - DNA, 10 bp, Artificial Sequence
  intronic recognition element for splicing modifier (REMS)
  misc_feature (8)..(8): n is a, c, g, or t
gtgagtangc

SEQ ID NO: 2980 - DNA, 10 bp, Artificial Sequence
  intronic recognition element for splicing modifier (REMS)
  misc_feature (8)..(8): n is a, c, g, or t
ttgagtangc

SEQ ID NO: 2981 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtangg

SEQ ID NO: 2982 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtangg

SEQ ID NO: 2983 - DNA, 10 bp, Artificial Sequence
  intronic recognition element for splicing modifier (REMS)
  misc_feature (8)..(8): n is a, c, g, or t
aagagtangg

SEQ ID NO: 2984 - DNA, 10 bp, Artificial Sequence
  intronic recognition element for splicing modifier (REMS)
  misc_feature (8)..(8): n is a, c, g, or t
cagagtangg

SEQ ID NO: 2985 - DNA, 10 bp, Artificial Sequence
  intronic recognition element for splicing modifier (REMS)
  misc_feature (8)..(8): n is a, c, g, or t
gagagtangg

SEQ ID NO: 2986 - DNA, 10 bp, Artificial Sequence
  intronic recognition element for splicing modifier (REMS)
  misc_feature (8)..(8): n is a, c, g, or t
tagagtangg

SEQ ID NO: 2987 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtangg

SEQ ID NO: 2988 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtangg

SEQ ID NO: 2989 - DNA, 10 bp, Artificial Sequence
  intronic recognition element for splicing modifier (REMS)
  misc_feature (8)..(8): n is a, c, g, or t
acgagtangg

SEQ ID NO: 2990 - DNA, 10 bp, Artificial Sequence
  intronic recognition element for splicing modifier (REMS)
  misc_feature (8)..(8): n is a, c, g, or t
ccgagtangg

SEQ ID NO: 2991 - DNA, 10 bp, Artificial Sequence
  intronic recognition element for splicing modifier (REMS)
  misc_feature (8)..(8): n is a, c, g, or t
gcgagtangg

SEQ ID NO: 2992 - DNA, 10 bp, Artificial Sequence
  intronic recognition element for splicing modifier (REMS)
  misc_feature (8)..(8): n is a, c, g, or t
tcgagtangg

SEQ ID NO: 2993 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtangg

SEQ ID NO: 2994 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtangg

SEQ ID NO: 2995 - DNA, 10 bp, Artificial Sequence
  intronic recognition element for splicing modifier (REMS)
  misc_feature (8)..(8): n is a, c, g, or t
aggagtangg

SEQ ID NO: 2996 - DNA, 10 bp, Artificial Sequence
  intronic recognition element for splicing modifier (REMS)
  misc_feature (8)..(8): n is a, c, g, or t
cggagtangg

SEQ ID NO: 2997 - DNA, 10 bp, Artificial Sequence
  intronic recognition element for splicing modifier (REMS)
  misc_feature (8)..(8): n is a, c, g, or t
gggagtangg

SEQ ID NO: 2998 - DNA, 10 bp, Artificial Sequence
  intronic recognition element for splicing modifier (REMS)
  misc_feature (8)..(8): n is a, c, g, or t
tggagtangg

SEQ ID NO: 2999 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtangg

SEQ ID NO: 3000 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtangg

SEQ ID NO: 3001 - DNA, 10 bp, Artificial Sequence
  intronic recognition element for splicing modifier (REMS)
  misc_feature (8)..(8): n is a, c, g, or t
atgagtangg

SEQ ID NO: 3002 - DNA, 10 bp, Artificial Sequence
  intronic recognition element for splicing modifier (REMS)
  misc_feature (8)..(8): n is a, c, g, or t
ctgagtangg

SEQ ID NO: 3003 - DNA, 10 bp, Artificial Sequence
  intronic recognition element for splicing modifier (REMS)
  misc_feature (8)..(8): n is a, c, g, or t
gtgagtangg

SEQ ID NO: 3004 - DNA, 10 bp, Artificial Sequence
  intronic recognition element for splicing modifier (REMS)
  misc_feature (8)..(8): n is a, c, g, or t
ttgagtangg

SEQ ID NO: 3005 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
angagtangt

SEQ ID NO: 3006 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nagagtangt

SEQ ID NO: 3007 - DNA, 10 bp, Artificial Sequence
  intronic recognition element for splicing modifier (REMS)
  misc_feature (8)..(8): n is a, c, g, or t
aagagtangt

SEQ ID NO: 3008 - DNA, 10 bp, Artificial Sequence
  intronic recognition element for splicing modifier (REMS)
  misc_feature (8)..(8): n is a, c, g, or t
cagagtangt

SEQ ID NO: 3009 - DNA, 10 bp, Artificial Sequence
  intronic recognition element for splicing modifier (REMS)
  misc_feature (8)..(8): n is a, c, g, or t
gagagtangt

SEQ ID NO: 3010 - DNA, 10 bp, Artificial Sequence
  intronic recognition element for splicing modifier (REMS)
  misc_feature (8)..(8): n is a, c, g, or t
tagagtangt

SEQ ID NO: 3011 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
cngagtangt

SEQ ID NO: 3012 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ncgagtangt

SEQ ID NO: 3013 - DNA, 10 bp, Artificial Sequence
  intronic recognition element for splicing modifier (REMS)
  misc_feature (8)..(8): n is a, c, g, or t
acgagtangt

SEQ ID NO: 3014 - DNA, 10 bp, Artificial Sequence
  intronic recognition element for splicing modifier (REMS)
  misc_feature (8)..(8): n is a, c, g, or t
ccgagtangt

SEQ ID NO: 3015 - DNA, 10 bp, Artificial Sequence
  intronic recognition element for splicing modifier (REMS)
  misc_feature (8)..(8): n is a, c, g, or t
gcgagtangt

SEQ ID NO: 3016 - DNA, 10 bp, Artificial Sequence
  intronic recognition element for splicing modifier (REMS)
  misc_feature (8)..(8): n is a, c, g, or t
tcgagtangt

SEQ ID NO: 3017 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
gngagtangt

SEQ ID NO: 3018 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
nggagtangt

SEQ ID NO: 3019 - DNA, 10 bp, Artificial Sequence
  intronic recognition element for splicing modifier (REMS)
  misc_feature (8)..(8): n is a, c, g, or t
aggagtangt

SEQ ID NO: 3020 - DNA, 10 bp, Artificial Sequence
  intronic recognition element for splicing modifier (REMS)
  misc_feature (8)..(8): n is a, c, g, or t
cggagtangt

SEQ ID NO: 3021 - DNA, 10 bp, Artificial Sequence
  intronic recognition element for splicing modifier (REMS)
  misc_feature (8)..(8): n is a, c, g, or t
gggagtangt

SEQ ID NO: 3022 - DNA, 10 bp, Artificial Sequence
  intronic recognition element for splicing modifier (REMS)
  misc_feature (8)..(8): n is a, c, g, or t
tggagtangt

SEQ ID NO: 3023 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
tngagtangt

SEQ ID NO: 3024 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
ntgagtangt

SEQ ID NO: 3025 - DNA, 10 bp, Artificial Sequence
  intronic recognition element for splicing modifier (REMS)
  misc_feature (8)..(8): n is a, c, g, or t
atgagtangt

SEQ ID NO: 3026 - DNA, 10 bp, Artificial Sequence
  intronic recognition element for splicing modifier (REMS)
  misc_feature (8)..(8): n is a, c, g, or t
ctgagtangt

SEQ ID NO: 3027 - DNA, 10 bp, Artificial Sequence
  intronic recognition element for splicing modifier (REMS)
  misc_feature (8)..(8): n is a, c, g, or t
gtgagtangt

SEQ ID NO: 3028 - DNA, 10 bp, Artificial Sequence
  intronic recognition element for splicing modifier (REMS)
  misc_feature (8)..(8): n is a, c, g, or t
ttgagtangt

SEQ ID NO: 3029 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
angagtgngn

SEQ ID NO: 3030 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
nagagtgngn

SEQ ID NO: 3031 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
aagagtgngn

SEQ ID NO: 3032 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
cagagtgngn

SEQ ID NO: 3033 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gagagtgngn

SEQ ID NO: 3034 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tagagtgngn

SEQ ID NO: 3035 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
cngagtgngn

SEQ ID NO: 3036 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
ncgagtgngn

SEQ ID NO: 3037 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
acgagtgngn

SEQ ID NO: 3038 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ccgagtgngn

SEQ ID NO: 3039 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gcgagtgngn

SEQ ID NO: 3040 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tcgagtgngn

SEQ ID NO: 3041 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
gngagtgngn

SEQ ID NO: 3042 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
nggagtgngn

SEQ ID NO: 3043 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
aggagtgngn

SEQ ID NO: 3044 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
cggagtgngn

SEQ ID NO: 3045 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gggagtgngn

SEQ ID NO: 3046 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
tggagtgngn

SEQ ID NO: 3047 - DNA, 10 bp, Artificial Sequence
  intronic recognition element for splicing modifier (REMS)
  misc_feature (2)..(2): n is a, c, g, or t
  misc_feature (8)..(8): n is a, c, g, or t
  misc_feature (10)..(10): n is a, c, g, or t
tngagtgngn

SEQ ID NO: 3048 - DNA, 10 bp, Artificial Sequence
  intronic recognition element for splicing modifier (REMS)
  misc_feature (1)..(1): n is a, c, g, or t
  misc_feature (8)..(8): n is a, c, g, or t
  misc_feature (10)..(10): n is a, c, g, or t
ntgagtgngn

SEQ ID NO: 3049 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
atgagtgngn

SEQ ID NO: 3050 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ctgagtgngn

SEQ ID NO: 3051 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
gtgagtgngn

SEQ ID NO: 3052 - DNA, 10 bp, Artificial Sequence
  intronic recognition element for splicing modifier (REMS)
  misc_feature (8)..(8): n is a, c, g, or t
  misc_feature (10)..(10): n is a, c, g, or t
ttgagtgngn

SEQ ID NO: 3053 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtgagn

SEQ ID NO: 3054 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtgagn

SEQ ID NO: 3055 - DNA, 10 bp, Artificial Sequence
  intronic recognition element for splicing modifier (REMS)
  misc_feature (10)..(10): n is a, c, g, or t
aagagtgagn

SEQ ID NO: 3056 - DNA, 10 bp, Artificial Sequence
  intronic recognition element for splicing modifier (REMS)
  misc_feature (10)..(10): n is a, c, g, or t
cagagtgagn

SEQ ID NO: 3057 - DNA, 10 bp, Artificial Sequence
  intronic recognition element for splicing modifier (REMS)
  misc_feature (10)..(10): n is a, c, g, or t
gagagtgagn

SEQ ID NO: 3058 - DNA, 10 bp, Artificial Sequence
  intronic recognition element for splicing modifier (REMS)
  misc_feature (10)..(10): n is a, c, g, or t
tagagtgagn

SEQ ID NO: 3059 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtgagn

SEQ ID NO: 3060 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtgagn

SEQ ID NO: 3061 - DNA, 10 bp, Artificial Sequence
  intronic recognition element for splicing modifier (REMS)
  misc_feature (10)..(10): n is a, c, g, or t
acgagtgagn

SEQ ID NO: 3062 - DNA, 10 bp, Artificial Sequence
  intronic recognition element for splicing modifier (REMS)
  misc_feature (10)..(10): n is a, c, g, or t
ccgagtgagn

SEQ ID NO: 3063 - DNA, 10 bp, Artificial Sequence
  intronic recognition element for splicing modifier (REMS)
  misc_feature (10)..(10): n is a, c, g, or t
gcgagtgagn

SEQ ID NO: 3064 - DNA, 10 bp, Artificial Sequence
  intronic recognition element for splicing modifier (REMS)
  misc_feature (10)..(10): n is a, c, g, or t
tcgagtgagn

SEQ ID NO: 3065 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtgagn

SEQ ID NO: 3066 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtgagn

SEQ ID NO: 3067 - DNA, 10 bp, Artificial Sequence
  intronic recognition element for splicing modifier (REMS)
  misc_feature (10)..(10): n is a, c, g, or t
aggagtgagn

SEQ ID NO: 3068 - DNA, 10 bp, Artificial Sequence
  intronic recognition element for splicing modifier (REMS)
  misc_feature (10)..(10): n is a, c, g, or t
cggagtgagn

SEQ ID NO: 3069 - DNA, 10 bp, Artificial Sequence
  intronic recognition element for splicing modifier (REMS)
  misc_feature (10)..(10): n is a, c, g, or t
gggagtgagn

SEQ ID NO: 3070 - DNA, 10 bp, Artificial Sequence
  intronic recognition element for splicing modifier (REMS)
  misc_feature (10)..(10): n is a, c, g, or t
tggagtgagn

SEQ ID NO: 3071 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtgagn

SEQ ID NO: 3072 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtgagn

SEQ ID NO: 3073 - DNA, 10 bp, Artificial Sequence
  intronic recognition element for splicing modifier (REMS)
  misc_feature (10)..(10): n is a, c, g, or t
atgagtgagn

SEQ ID NO: 3074 - DNA, 10 bp, Artificial Sequence
  intronic recognition element for splicing modifier (REMS)
  misc_feature (10)..(10): n is a, c, g, or t
ctgagtgagn

SEQ ID NO: 3075 - DNA, 10 bp, Artificial Sequence
  intronic recognition element for splicing modifier (REMS)
  misc_feature (10)..(10): n is a, c, g, or t
gtgagtgagn

SEQ ID NO: 3076 - DNA, 10 bp, Artificial Sequence
  intronic recognition element for splicing modifier (REMS)
  misc_feature (10)..(10): n is a, c, g, or t
ttgagtgagn

SEQ ID NO: 3077 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtgcgn

SEQ ID NO: 3078 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtgcgn

SEQ ID NO: 3079 - DNA, 10 bp, Artificial Sequence
  intronic recognition element for splicing modifier (REMS)
  misc_feature (10)..(10): n is a, c, g, or t
aagagtgcgn

SEQ ID NO: 3080 - DNA, 10 bp, Artificial Sequence
  intronic recognition element for splicing modifier (REMS)
  misc_feature (10)..(10): n is a, c, g, or t
cagagtgcgn

SEQ ID NO: 3081 - DNA, 10 bp, Artificial Sequence
  intronic recognition element for splicing modifier (REMS)
  misc_feature (10)..(10): n is a, c, g, or t
gagagtgcgn

SEQ ID NO: 3082 - DNA, 10 bp, Artificial Sequence
  intronic recognition element for splicing modifier (REMS)
  misc_feature (10)..(10): n is a, c, g, or t
tagagtgcgn

SEQ ID NO: 3083 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtgcgn

SEQ ID NO: 3084 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtgcgn

SEQ ID NO: 3085 - DNA, 10 bp, Artificial Sequence
  intronic recognition element for splicing modifier (REMS)
  misc_feature (10)..(10): n is a, c, g, or t
acgagtgcgn

SEQ ID NO: 3086 - DNA, 10 bp, Artificial Sequence
  intronic recognition element for splicing modifier (REMS)
  misc_feature (10)..(10): n is a, c, g, or t
ccgagtgcgn

SEQ ID NO: 3087 - DNA, 10 bp, Artificial Sequence
  intronic recognition element for splicing modifier (REMS)
  misc_feature (10)..(10): n is a, c, g, or t
gcgagtgcgn

SEQ ID NO: 3088 - DNA, 10 bp, Artificial Sequence
  intronic recognition element for splicing modifier (REMS)
  misc_feature (10)..(10): n is a, c, g, or t
tcgagtgcgn

SEQ ID NO: 3089 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtgcgn

SEQ ID NO: 3090 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtgcgn

SEQ ID NO: 3091 - DNA, 10 bp, Artificial Sequence
  intronic recognition element for splicing modifier (REMS)
  misc_feature (10)..(10): n is a, c, g, or t
aggagtgcgn

SEQ ID NO: 3092 - DNA, 10 bp, Artificial Sequence
  intronic recognition element for splicing modifier (REMS)
  misc_feature (10)..(10): n is a, c, g, or t
cggagtgcgn

SEQ ID NO: 3093 - DNA, 10 bp, Artificial Sequence
  intronic recognition element for splicing modifier (REMS)
  misc_feature (10)..(10): n is a, c, g, or t
gggagtgcgn

SEQ ID NO: 3094 - DNA, 10 bp, Artificial Sequence
  intronic recognition element for splicing modifier (REMS)
  misc_feature (10)..(10): n is a, c, g, or t
tggagtgcgn

SEQ ID NO: 3095 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtgcgn

SEQ ID NO: 3096 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtgcgn

SEQ ID NO: 3097 - DNA, 10 bp, Artificial Sequence
  intronic recognition element for splicing modifier (REMS)
  misc_feature (10)..(10): n is a, c, g, or t
atgagtgcgn

SEQ ID NO: 3098 - DNA, 10 bp, Artificial Sequence
  intronic recognition element for splicing modifier (REMS)
  misc_feature (10)..(10): n is a, c, g, or t
ctgagtgcgn

SEQ ID NO: 3099 - DNA, 10 bp, Artificial Sequence
  intronic recognition element for splicing modifier (REMS)
  misc_feature (10)..(10): n is a, c, g, or t
gtgagtgcgn

SEQ ID NO: 3100 - DNA, 10 bp, Artificial Sequence
  intronic recognition element for splicing modifier (REMS)
  misc_feature (10)..(10): n is a, c, g, or t
ttgagtgcgn

SEQ ID NO: 3101 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtgggn

SEQ ID NO: 3102 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtgggn

SEQ ID NO: 3103 - DNA, 10 bp, Artificial Sequence
  intronic recognition element for splicing modifier (REMS)
  misc_feature (10)..(10): n is a, c, g, or t
aagagtgggn

SEQ ID NO: 3104 - DNA, 10 bp, Artificial Sequence
  intronic recognition element for splicing modifier (REMS)
  misc_feature (10)..(10): n is a, c, g, or t
cagagtgggn

SEQ ID NO: 3105 - DNA, 10 bp, Artificial Sequence
  intronic recognition element for splicing modifier (REMS)
  misc_feature (10)..(10): n is a, c, g, or t
gagagtgggn

SEQ ID NO: 3106 - DNA, 10 bp, Artificial Sequence
  intronic recognition element for splicing modifier (REMS)
  misc_feature (10)..(10): n is a, c, g, or t
tagagtgggn

SEQ ID NO: 3107 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtgggn

SEQ ID NO: 3108 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtgggn

SEQ ID NO: 3109 - DNA, 10 bp, Artificial Sequence
  intronic recognition element for splicing modifier (REMS)
  misc_feature (10)..(10): n is a, c, g, or t
acgagtgggn

SEQ ID NO: 3110 - DNA, 10 bp, Artificial Sequence
  intronic recognition element for splicing modifier (REMS)
  misc_feature (10)..(10): n is a, c, g, or t
ccgagtgggn

SEQ ID NO: 3111 - DNA, 10 bp, Artificial Sequence
  intronic recognition element for splicing modifier (REMS)
  misc_feature (10)..(10): n is a, c, g, or t
gcgagtgggn

SEQ ID NO: 3112 - DNA, 10 bp, Artificial Sequence
  intronic recognition element for splicing modifier (REMS)
  misc_feature (10)..(10): n is a, c, g, or t
tcgagtgggn

SEQ ID NO: 3113 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtgggn

SEQ ID NO: 3114 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtgggn

SEQ ID NO: 3115 - DNA, 10 bp, Artificial Sequence
  intronic recognition element for splicing modifier (REMS)
  misc_feature (10)..(10): n is a, c, g, or t
aggagtgggn

SEQ ID NO: 3116 - DNA, 10 bp, Artificial Sequence
  intronic recognition element for splicing modifier (REMS)
  misc_feature (10)..(10): n is a, c, g, or t
cggagtgggn

SEQ ID NO: 3117 - DNA, 10 bp, Artificial Sequence
  intronic recognition element for splicing modifier (REMS)
  misc_feature (10)..(10): n is a, c, g, or t
gggagtgggn

SEQ ID NO: 3118 - DNA, 10 bp, Artificial Sequence
  intronic recognition element for splicing modifier (REMS)
  misc_feature (10)..(10): n is a, c, g, or t
tggagtgggn

SEQ ID NO: 3119 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtgggn

SEQ ID NO: 3120 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtgggn

SEQ ID NO: 3121 - DNA, 10 bp, Artificial Sequence
  intronic recognition element for splicing modifier (REMS)
  misc_feature (10)..(10): n is a, c, g, or t
atgagtgggn

SEQ ID NO: 3122 - DNA, 10 bp, Artificial Sequence
  intronic recognition element for splicing modifier (REMS)
  misc_feature (10)..(10): n is a, c, g, or t
ctgagtgggn

SEQ ID NO: 3123 - DNA, 10 bp, Artificial Sequence
  intronic recognition element for splicing modifier (REMS)
  misc_feature (10)..(10): n is a, c, g, or t
gtgagtgggn

SEQ ID NO: 3124 - DNA, 10 bp, Artificial Sequence
  intronic recognition element for splicing modifier (REMS)
  misc_feature (10)..(10): n is a, c, g, or t
ttgagtgggn

SEQ ID NO: 3125 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
angagtgtgn

SEQ ID NO: 3126 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nagagtgtgn

SEQ ID NO: 3127 - DNA, 10 bp, Artificial Sequence
  intronic recognition element for splicing modifier (REMS)
  misc_feature (10)..(10): n is a, c, g, or t
aagagtgtgn

SEQ ID NO: 3128 - DNA, 10 bp, Artificial Sequence
  intronic recognition element for splicing modifier (REMS)
  misc_feature (10)..(10): n is a, c, g, or t
cagagtgtgn

SEQ ID NO: 3129 - DNA, 10 bp, Artificial Sequence
  intronic recognition element for splicing modifier (REMS)
  misc_feature (10)..(10): n is a, c, g, or t
gagagtgtgn

SEQ ID NO: 3130 - DNA, 10 bp, Artificial Sequence
  intronic recognition element for splicing modifier (REMS)
  misc_feature (10)..(10): n is a, c, g, or t
tagagtgtgn

SEQ ID NO: 3131 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
cngagtgtgn

SEQ ID NO: 3132 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ncgagtgtgn

SEQ ID NO: 3133 - DNA, 10 bp, Artificial Sequence
  intronic recognition element for splicing modifier (REMS)
  misc_feature (10)..(10): n is a, c, g, or t
acgagtgtgn

SEQ ID NO: 3134 - DNA, 10 bp, Artificial Sequence
  intronic recognition element for splicing modifier (REMS)
  misc_feature (10)..(10): n is a, c, g, or t
ccgagtgtgn

SEQ ID NO: 3135 - DNA, 10 bp, Artificial Sequence
  intronic recognition element for splicing modifier (REMS)
  misc_feature (10)..(10): n is a, c, g, or t
gcgagtgtgn

SEQ ID NO: 3136 - DNA, 10 bp, Artificial Sequence
  intronic recognition element for splicing modifier (REMS)
  misc_feature (10)..(10): n is a, c, g, or t
tcgagtgtgn

SEQ ID NO: 3137 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
gngagtgtgn

SEQ ID NO: 3138 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
nggagtgtgn

SEQ ID NO: 3139 - DNA, 10 bp, Artificial Sequence
  intronic recognition element for splicing modifier (REMS)
  misc_feature (10)..(10): n is a, c, g, or t
aggagtgtgn

SEQ ID NO: 3140 - DNA, 10 bp, Artificial Sequence
  intronic recognition element for splicing modifier (REMS)
  misc_feature (10)..(10): n is a, c, g, or t
cggagtgtgn

SEQ ID NO: 3141 - DNA, 10 bp, Artificial Sequence
  intronic recognition element for splicing modifier (REMS)
  misc_feature (10)..(10): n is a, c, g, or t
gggagtgtgn

SEQ ID NO: 3142 - DNA, 10 bp, Artificial Sequence
  intronic recognition element for splicing modifier (REMS)
  misc_feature (10)..(10): n is a, c, g, or t
tggagtgtgn

SEQ ID NO: 3143 - DNA, 10 bp, Artificial Sequence
  intronic recognition element for splicing modifier (REMS)
  misc_feature (2)..(2): n is a, c, g, or t
  misc_feature (10)..(10): n is a, c, g, or t
tngagtgtgn

SEQ ID NO: 3144 - DNA, 10 bp, Artificial Sequence
  intronic recognition element for splicing modifier (REMS)
  misc_feature (1)..(1): n is a, c, g, or t
  misc_feature (10)..(10): n is a, c, g, or t
ntgagtgtgn

SEQ ID NO: 3145 - DNA, 10 bp, Artificial Sequence
  intronic recognition element for splicing modifier (REMS)
  misc_feature (10)..(10): n is a, c, g, or t
atgagtgtgn

SEQ ID NO: 3146 - DNA, 10 bp, Artificial Sequence
  intronic recognition element for splicing modifier (REMS)
  misc_feature (10)..(10): n is a, c, g, or t
ctgagtgtgn

SEQ ID NO: 3147 - DNA, 10 bp, Artificial Sequence
  intronic recognition element for splicing modifier (REMS)
  misc_feature (10)..(10): n is a, c, g, or t
gtgagtgtgn

SEQ ID NO: 3148 - DNA, 10 bp, Artificial Sequence
  intronic recognition element for splicing modifier (REMS)
  misc_feature (10)..(10): n is a, c, g, or t
ttgagtgtgn

SEQ ID NO: 3149 - DNA, 10 bp, Artificial Sequence
  intronic recognition element for splicing modifier (REMS)
  misc_feature (2)..(2): n is a, c, g, or t
angagtgaga

SEQ ID NO: 3150 - DNA, 10 bp, Artificial Sequence
  intronic recognition element for splicing modifier (REMS)
  misc_feature (1)..(1): n is a, c, g, or t
nagagtgaga

SEQ ID NO: 3151 - DNA, 10 bp, Artificial Sequence
  intronic recognition element for splicing modifier (REMS)
aagagtgaga

SEQ ID NO: 3152 - DNA, 10 bp, Artificial Sequence
  intronic recognition element for splicing modifier (REMS)
cagagtgaga

SEQ ID NO: 3153 - DNA, 10 bp, Artificial Sequence
  intronic recognition element for splicing modifier (REMS)
gagagtgaga

SEQ ID NO: 3154 - DNA, 10 bp, Artificial Sequence
  intronic recognition element for splicing modifier (REMS)
tagagtgaga

SEQ ID NO: 3155 - DNA, 10 bp, Artificial Sequence
  intronic recognition element for splicing modifier (REMS)
  misc_feature (2)..(2): n is a, c, g, or t
cngagtgaga

SEQ ID NO: 3156 - DNA, 10 bp, Artificial Sequence
  intronic recognition element for splicing modifier (REMS)
  misc_feature (1)..(1): n is a, c, g, or t
ncgagtgaga

SEQ ID NO: 3157 - DNA, 10 bp, Artificial Sequence
  intronic recognition element for splicing modifier (REMS)
acgagtgaga

SEQ ID NO: 3158 - DNA, 10 bp, Artificial Sequence
  intronic recognition element for splicing modifier (REMS)
ccgagtgaga

SEQ ID NO: 3159 - DNA, 10 bp, Artificial Sequence
  intronic recognition element for splicing modifier (REMS)
gcgagtgaga

SEQ ID NO: 3160 - DNA, 10 bp, Artificial Sequence
  intronic recognition element for splicing modifier (REMS)
tcgagtgaga

SEQ ID NO: 3161 - DNA, 10 bp, Artificial Sequence
  intronic recognition element for splicing modifier (REMS)
  misc_feature (2)..(2): n is a, c, g, or t
gngagtgaga

SEQ ID NO: 3162 - DNA, 10 bp, Artificial Sequence
  intronic recognition element for splicing modifier (REMS)
  misc_feature (1)..(1): n is a, c, g, or t
nggagtgaga

SEQ ID NO: 3163 - DNA, 10 bp, Artificial Sequence
  intronic recognition element for splicing modifier (REMS)
aggagtgaga

SEQ ID NO: 3164 - DNA, 10 bp, Artificial Sequence
  intronic recognition element for splicing modifier (REMS)
cggagtgaga

SEQ ID NO: 3165 - DNA, 10 bp, Artificial Sequence
  intronic recognition element for splicing modifier (REMS)
gggagtgaga

SEQ ID NO: 3166 - DNA, 10 bp, Artificial Sequence
  intronic recognition element for splicing modifier (REMS)
tggagtgaga

SEQ ID NO: 3167 - DNA, 10 bp, Artificial Sequence
  intronic recognition element for splicing modifier (REMS)
  misc_feature (2)..(2): n is a, c, g, or t
tngagtgaga

SEQ ID NO: 3168 - DNA, 10 bp, Artificial Sequence
  intronic recognition element for splicing modifier (REMS)
  misc_feature (1)..(1): n is a, c, g, or t
ntgagtgaga

SEQ ID NO: 3169 - DNA, 10 bp, Artificial Sequence
  intronic recognition element for splicing modifier (REMS)
atgagtgaga

SEQ ID NO: 3170 - DNA, 10 bp, Artificial Sequence
  intronic recognition element for splicing modifier (REMS)
ctgagtgaga

SEQ ID NO: 3171 - DNA, 10 bp, Artificial Sequence
  intronic recognition element for splicing modifier (REMS)
gtgagtgaga

SEQ ID NO: 3172 - DNA, 10 bp, Artificial Sequence
  intronic recognition element for splicing modifier (REMS)
ttgagtgaga

SEQ ID NO: 3173 - DNA, 10 bp, Artificial Sequence
  intronic recognition element for splicing modifier (REMS)
  misc_feature (2)..(2): n is a, c, g, or t
angagtgcga

SEQ ID NO: 3174 - DNA, 10 bp, Artificial Sequence
  intronic recognition element for splicing modifier (REMS)
  misc_feature (1)..(1): n is a, c, g, or t
nagagtgcga

SEQ ID NO: 3175 - DNA, 10 bp, Artificial Sequence
  intronic recognition element for splicing modifier (REMS)
aagagtgcga

SEQ ID NO: 3176 - DNA, 10 bp, Artificial Sequence
  intronic recognition element for splicing modifier (REMS)
cagagtgcga

SEQ ID NO: 3177 - DNA, 10 bp, Artificial Sequence
  intronic recognition element for splicing modifier (REMS)
gagagtgcga

SEQ ID NO: 3178 - DNA, 10 bp, Artificial Sequence
  intronic recognition element for splicing modifier (REMS)
tagagtgcga

SEQ ID NO: 3179 - DNA, 10 bp, Artificial Sequence
  intronic recognition element for splicing modifier (REMS)
  misc_feature (2)..(2): n is a, c, g, or t
cngagtgcga

SEQ ID NO: 3180 - DNA, 10 bp, Artificial Sequence
  intronic recognition element for splicing modifier (REMS)
  misc_feature (1)..(1): n is a, c, g, or t
ncgagtgcga

SEQ ID NO: 3181 - DNA, 10 bp, Artificial Sequence
  intronic recognition element for splicing modifier (REMS)
acgagtgcga

SEQ ID NO: 3182 - DNA, 10 bp, Artificial Sequence
  intronic recognition element for splicing modifier (REMS)
ccgagtgcga

SEQ ID NO: 3183 - DNA, 10 bp, Artificial Sequence
  intronic recognition element for splicing modifier (REMS)
gcgagtgcga

SEQ ID NO: 3184 - DNA, 10 bp, Artificial Sequence
  intronic recognition element for splicing modifier (REMS)
tcgagtgcga

SEQ ID NO: 3185 - DNA, 10 bp, Artificial Sequence
  intronic recognition element for splicing modifier (REMS)
  misc_feature (2)..(2): n is a, c, g, or t
gngagtgcga

SEQ ID NO: 3186 - DNA, 10 bp, Artificial Sequence
  intronic recognition element for splicing modifier (REMS)
  misc_feature (1)..(1): n is a, c, g, or t
nggagtgcga

SEQ ID NO: 3187 - DNA, 10 bp, Artificial Sequence
  intronic recognition element for splicing modifier (REMS)
aggagtgcga

SEQ ID NO: 3188 - DNA, 10 bp, Artificial Sequence
  intronic recognition element for splicing modifier (REMS)
cggagtgcga

SEQ ID NO: 3189 - DNA, 10 bp, Artificial Sequence
  intronic recognition element for splicing modifier (REMS)
gggagtgcga

SEQ ID NO: 3190 - DNA, 10 bp, Artificial Sequence
  intronic recognition element for splicing modifier (REMS)
tggagtgcga

SEQ ID NO: 3191 - DNA, 10 bp, Artificial Sequence
  intronic recognition element for splicing modifier (REMS)
  misc_feature (2)..(2): n is a, c, g, or t
tngagtgcga

SEQ ID NO: 3192 - DNA, 10 bp, Artificial Sequence
  intronic recognition element for splicing modifier (REMS)
  misc_feature (1)..(1): n is a, c, g, or t
ntgagtgcga

SEQ ID NO: 3193 - DNA, 10 bp, Artificial Sequence
  intronic recognition element for splicing modifier (REMS)
atgagtgcga

SEQ ID NO: 3194 - DNA, 10 bp, Artificial Sequence
  intronic recognition element for splicing modifier (REMS)
ctgagtgcga

SEQ ID NO: 3195 - DNA, 10 bp, Artificial Sequence
  intronic recognition element for splicing modifier (REMS)
gtgagtgcga

SEQ ID NO: 3196 - DNA, 10 bp, Artificial Sequence
  intronic recognition element for splicing modifier (REMS)
ttgagtgcga

SEQ ID NO: 3197 - DNA, 10 bp, Artificial Sequence
  intronic recognition element for splicing modifier (REMS)
  misc_feature (2)..(2): n is a, c, g, or t
angagtggga

SEQ ID NO: 3198 - DNA, 10 bp, Artificial Sequence
  intronic recognition element for splicing modifier (REMS)
  misc_feature (1)..(1): n is a, c, g, or t
nagagtggga

SEQ ID NO: 3199 - DNA, 10 bp, Artificial Sequence
  intronic recognition element for splicing modifier (REMS)
aagagtggga

SEQ ID NO: 3200 - DNA, 10 bp, Artificial Sequence
  intronic recognition element for splicing modifier (REMS)
cagagtggga

SEQ ID NO: 3201 - DNA, 10 bp, Artificial Sequence
  intronic recognition element for splicing modifier (REMS)
gagagtggga

SEQ ID NO: 3202 - DNA, 10 bp, Artificial Sequence
  intronic recognition element for splicing modifier (REMS)
tagagtggga

SEQ ID NO: 3203 - DNA, 10 bp, Artificial Sequence
  intronic recognition element for splicing modifier (REMS)
  misc_feature (2)..(2): n is a, c, g, or t
cngagtggga

SEQ ID NO: 3204 - DNA, 10 bp, Artificial Sequence
  intronic recognition element for splicing modifier (REMS)
  misc_feature (1)..(1): n is a, c, g, or t
ncgagtggga

SEQ ID NO: 3205 - DNA, 10 bp, Artificial Sequence
  intronic recognition element for splicing modifier (REMS)
acgagtggga

SEQ ID NO: 3206 - DNA, 10 bp, Artificial Sequence
  intronic recognition element for splicing modifier (REMS)
ccgagtggga

SEQ ID NO: 3207 - DNA, 10 bp, Artificial Sequence
  intronic recognition element for splicing modifier (REMS)
gcgagtggga

SEQ ID NO: 3208 - DNA, 10 bp, Artificial Sequence
  intronic recognition element for splicing modifier (REMS)
tcgagtggga

SEQ ID NO: 3209 - DNA, 10 bp, Artificial Sequence
  intronic recognition element for splicing modifier (REMS)
  misc_feature (2)..(2): n is a, c, g, or t
gngagtggga

SEQ ID NO: 3210 - DNA, 10 bp, Artificial Sequence
  intronic recognition element for splicing modifier (REMS)
  misc_feature (1)..(1): n is a, c, g, or t
nggagtggga

SEQ ID NO: 3211 - DNA, 10 bp, Artificial Sequence
  intronic recognition element for splicing modifier (REMS)
aggagtggga

SEQ ID NO: 3212 - DNA, 10 bp, Artificial Sequence
  intronic recognition element for splicing modifier (REMS)
cggagtggga

SEQ ID NO: 3213 - DNA, 10 bp, Artificial Sequence
  intronic recognition element for splicing modifier (REMS)
gggagtggga

SEQ ID NO: 3214 - DNA, 10 bp, Artificial Sequence
  intronic recognition element for splicing modifier (REMS)
tggagtggga

SEQ ID NO: 3215 - DNA, 10 bp, Artificial Sequence
  intronic recognition element for splicing modifier (REMS)
  misc_feature (2)..(2): n is a, c, g, or t
tngagtggga

SEQ ID NO: 3216 - DNA, 10 bp, Artificial Sequence
  intronic recognition element for splicing modifier (REMS)
  misc_feature (1)..(1): n is a, c, g, or t
ntgagtggga

SEQ ID NO: 3217 - DNA, 10 bp, Artificial Sequence
  intronic recognition element for splicing modifier (REMS)
atgagtggga

SEQ ID NO: 3218 - DNA, 10 bp, Artificial Sequence
  intronic recognition element for splicing modifier (REMS)
ctgagtggga

SEQ ID NO: 3219 - DNA, 10 bp, Artificial Sequence
  intronic recognition element for splicing modifier (REMS)
gtgagtggga

SEQ ID NO: 3220 - DNA, 10 bp, Artificial Sequence
  intronic recognition element for splicing modifier (REMS)
ttgagtggga

SEQ ID NO: 3221 - DNA, 10 bp, Artificial Sequence
  intronic recognition element for splicing modifier (REMS)
  misc_feature (2)..(2): n is a, c, g, or t
angagtgtga

SEQ ID NO: 3222 - DNA, 10 bp, Artificial Sequence
  intronic recognition element for splicing modifier (REMS)
  misc_feature (1)..(1): n is a, c, g, or t
nagagtgtga

SEQ ID NO: 3223 - DNA, 10 bp, Artificial Sequence
  intronic recognition element for splicing modifier (REMS)
aagagtgtga

SEQ ID NO: 3224 - DNA, 10 bp, Artificial Sequence
  intronic recognition element for splicing modifier (REMS)
cagagtgtga

SEQ ID NO: 3225 - DNA, 10 bp, Artificial Sequence
  intronic recognition element for splicing modifier (REMS)
gagagtgtga

SEQ ID NO: 3226 - DNA, 10 bp, Artificial Sequence
  intronic recognition element for splicing modifier (REMS)
tagagtgtga

SEQ ID NO: 3227 - DNA, 10 bp, Artificial Sequence
  intronic recognition element for splicing modifier (REMS)
  misc_feature (2)..(2): n is a, c, g, or t
cngagtgtga

SEQ ID NO: 3228 - DNA, 10 bp, Artificial Sequence
  intronic recognition element for splicing modifier (REMS)
  misc_feature (1)..(1): n is a, c, g, or t
ncgagtgtga

SEQ ID NO: 3229 - DNA, 10 bp, Artificial Sequence
  intronic recognition element for splicing modifier (REMS)
acgagtgtga

SEQ ID NO: 3230 - DNA, 10 bp, Artificial Sequence
  intronic recognition element for splicing modifier (REMS)
ccgagtgtga

SEQ ID NO: 3231 - DNA, 10 bp, Artificial Sequence
  intronic recognition element for splicing modifier (REMS)
gcgagtgtga

SEQ ID NO: 3232 - DNA, 10 bp, Artificial Sequence
  intronic recognition element for splicing modifier (REMS)
tcgagtgtga

SEQ ID NO: 3233 - DNA, 10 bp, Artificial Sequence
  intronic recognition element for splicing modifier (REMS)
  misc_feature (2)..(2): n is a, c, g, or t
gngagtgtga

SEQ ID NO: 3234 - DNA, 10 bp, Artificial Sequence
  intronic recognition element for splicing modifier (REMS)
  misc_feature (1)..(1): n is a, c, g, or t
nggagtgtga

SEQ ID NO: 3235 - DNA, 10 bp, Artificial Sequence
  intronic recognition element for splicing modifier (REMS)
aggagtgtga

SEQ ID NO: 3236 - DNA, 10 bp, Artificial Sequence
  intronic recognition element for splicing modifier (REMS)
cggagtgtga

SEQ ID NO: 3237 - DNA, 10 bp, Artificial Sequence
  intronic recognition element for splicing modifier (REMS)
gggagtgtga

SEQ ID NO: 3238 - DNA, 10 bp, Artificial Sequence
  intronic recognition element for splicing modifier (REMS)
tggagtgtga

SEQ ID NO: 3239 - DNA, 10 bp, Artificial Sequence
  intronic recognition element for splicing modifier (REMS)
  misc_feature (2)..(2): n is a, c, g, or t
tngagtgtga

SEQ ID NO: 3240 - DNA, 10 bp, Artificial Sequence
  intronic recognition element for splicing modifier (REMS)
  misc_feature (1)..(1): n is a, c, g, or t
ntgagtgtga

SEQ ID NO: 3241 - DNA, 10 bp, Artificial Sequence
  intronic recognition element for splicing modifier (REMS)
atgagtgtga

SEQ ID NO: 3242 - DNA, 10 bp, Artificial Sequence
  intronic recognition element for splicing modifier (REMS)
ctgagtgtga

SEQ ID NO: 3243 - DNA, 10 bp, Artificial Sequence
  intronic recognition element for splicing modifier (REMS)
gtgagtgtga

SEQ ID NO: 3244 - DNA, 10 bp, Artificial Sequence
  intronic recognition element for splicing modifier (REMS)
ttgagtgtga

SEQ ID NO: 3245 - DNA, 10 bp, Artificial Sequence
  intronic recognition element for splicing modifier (REMS)
  misc_feature (2)..(2): n is a, c, g, or t
angagtgagc

SEQ ID NO: 3246 - DNA, 10 bp, Artificial Sequence
  intronic recognition element for splicing modifier (REMS)
  misc_feature (1)..(1): n is a, c, g, or t
nagagtgagc

SEQ ID NO: 3247 - DNA, 10 bp, Artificial Sequence
  intronic recognition element for splicing modifier (REMS)
aagagtgagc

SEQ ID NO: 3248 - DNA, 10 bp, Artificial Sequence
  intronic recognition element for splicing modifier (REMS)
cagagtgagc

SEQ ID NO: 3249 - DNA, 10 bp, Artificial Sequence
  intronic recognition element for splicing modifier (REMS)
gagagtgagc

SEQ ID NO: 3250 - DNA, 10 bp, Artificial Sequence
  intronic recognition element for splicing modifier (REMS)
tagagtgagc

SEQ ID NO: 3251 - DNA, 10 bp, Artificial Sequence
  intronic recognition element for splicing modifier (REMS)
  misc_feature (2)..(2): n is a, c, g, or t
cngagtgagc

SEQ ID NO: 3252 - DNA, 10 bp, Artificial Sequence
  intronic recognition element for splicing modifier (REMS)
  misc_feature (1)..(1): n is a, c, g, or t
ncgagtgagc

SEQ ID NO: 3253 - DNA, 10 bp, Artificial Sequence
  intronic recognition element for splicing modifier (REMS)
acgagtgagc

SEQ ID NO: 3254 - DNA, 10 bp, Artificial Sequence
  intronic recognition element for splicing modifier (REMS)
ccgagtgagc

SEQ ID NO: 3255 - DNA, 10 bp, Artificial Sequence
  intronic recognition element for splicing modifier (REMS)
gcgagtgagc

SEQ ID NO: 3256 - DNA, 10 bp, Artificial Sequence
  intronic recognition element for splicing modifier (REMS)
tcgagtgagc

SEQ ID NO: 3257 - DNA, 10 bp, Artificial Sequence
  intronic recognition element for splicing modifier (REMS)
  misc_feature (2)..(2): n is a, c, g, or t
gngagtgagc

SEQ ID NO: 3258 - DNA, 10 bp, Artificial Sequence
  intronic recognition element for splicing modifier (REMS)
  misc_feature (1)..(1): n is a, c, g, or t
nggagtgagc

SEQ ID NO: 3259 - DNA, 10 bp, Artificial Sequence
  intronic recognition element for splicing modifier (REMS)
aggagtgagc

SEQ ID NO: 3260 - DNA, 10 bp, Artificial Sequence
  intronic recognition element for splicing modifier (REMS)
cggagtgagc

SEQ ID NO: 3261 - DNA, 10 bp, Artificial Sequence
  intronic recognition element for splicing modifier (REMS)
gggagtgagc

SEQ ID NO: 3262 - DNA, 10 bp, Artificial Sequence
  intronic recognition element for splicing modifier (REMS)
tggagtgagc

SEQ ID NO: 3263 - DNA, 10 bp, Artificial Sequence
  intronic recognition element for splicing modifier (REMS)
  misc_feature (2)..(2): n is a, c, g, or t
tngagtgagc

SEQ ID NO: 3264 - DNA, 10 bp, Artificial Sequence
  intronic recognition element for splicing modifier (REMS)
  misc_feature (1)..(1): n is a, c, g, or t
ntgagtgagc

SEQ ID NO: 3265 - DNA, 10 bp, Artificial Sequence
  intronic recognition element for splicing modifier (REMS)
atgagtgagc

SEQ ID NO: 3266 - DNA, 10 bp, Artificial Sequence
  intronic recognition element for splicing modifier (REMS)
ctgagtgagc

SEQ ID NO: 3267 - DNA, 10 bp, Artificial Sequence
  intronic recognition element for splicing modifier (REMS)
gtgagtgagc

SEQ ID NO: 3268 - DNA, 10 bp, Artificial Sequence
  intronic recognition element for splicing modifier (REMS)
ttgagtgagc

SEQ ID NO: 3269 - DNA, 10 bp, Artificial Sequence
  intronic recognition element for splicing modifier (REMS)
  misc_feature (2)..(2): n is a, c, g, or t
angagtgcgc

SEQ ID NO: 3270 - DNA, 10 bp, Artificial Sequence
  intronic recognition element for splicing modifier (REMS)
  misc_feature (1)..(1): n is a, c, g, or t
nagagtgcgc

SEQ ID NO: 3271 - DNA, 10 bp, Artificial Sequence
  intronic recognition element for splicing modifier (REMS)
aagagtgcgc

SEQ ID NO: 3272 - DNA, 10 bp, Artificial Sequence
  intronic recognition element for splicing modifier (REMS)
cagagtgcgc

SEQ ID NO: 3273 - DNA, 10 bp, Artificial Sequence
  intronic recognition element for splicing modifier (REMS)
gagagtgcgc

SEQ ID NO: 3274 - DNA, 10 bp, Artificial Sequence
  intronic recognition element for splicing modifier (REMS)
tagagtgcgc

SEQ ID NO: 3275 - DNA, 10 bp, Artificial Sequence
  intronic recognition element for splicing modifier (REMS)
  misc_feature (2)..(2): n is a, c, g, or t
cngagtgcgc

SEQ ID NO: 3276 - DNA, 10 bp, Artificial Sequence
  intronic recognition element for splicing modifier (REMS)
  misc_feature (1)..(1): n is a, c, g, or t
ncgagtgcgc

SEQ ID NO: 3277 - DNA, 10 bp, Artificial Sequence
  intronic recognition element for splicing modifier (REMS)
acgagtgcgc

SEQ ID NO: 3278 - DNA, 10 bp, Artificial Sequence
  intronic recognition element for splicing modifier (REMS)
ccgagtgcgc

SEQ ID NO: 3279 - DNA, 10 bp, Artificial Sequence
  intronic recognition element for splicing modifier (REMS)
gcgagtgcgc

SEQ ID NO: 3280 - DNA, 10 bp, Artificial Sequence
  intronic recognition element for splicing modifier (REMS)
tcgagtgcgc

SEQ ID NO: 3281 - DNA, 10 bp, Artificial Sequence
  intronic recognition element for splicing modifier (REMS)
  misc_feature (2)..(2): n is a, c, g, or t
gngagtgcgc

SEQ ID NO: 3282 - DNA, 10 bp, Artificial Sequence
  intronic recognition element for splicing modifier (REMS)
  misc_feature (1)..(1): n is a, c, g, or t
nggagtgcgc

SEQ ID NO: 3283 - DNA, 10 bp, Artificial Sequence
  intronic recognition element for splicing modifier (REMS)
aggagtgcgc

SEQ ID NO: 3284 - DNA, 10 bp, Artificial Sequence
  intronic recognition element for splicing modifier (REMS)
cggagtgcgc

SEQ ID NO: 3285 - DNA, 10 bp, Artificial Sequence
  intronic recognition element for splicing modifier (REMS)
gggagtgcgc

SEQ ID NO: 3286 - DNA, 10 bp, Artificial Sequence
  intronic recognition element for splicing modifier (REMS)
tggagtgcgc

SEQ ID NO: 3287 - DNA, 10 bp, Artificial Sequence
  intronic recognition element for splicing modifier (REMS)
  misc_feature (2)..(2): n is a, c, g, or t
tngagtgcgc

SEQ ID NO: 3288 - DNA, 10 bp, Artificial Sequence
  intronic recognition element for splicing modifier (REMS)
  misc_feature (1)..(1): n is a, c, g, or t
ntgagtgcgc

SEQ ID NO: 3289 - DNA, 10 bp, Artificial Sequence
  intronic recognition element for splicing modifier (REMS)
atgagtgcgc

SEQ ID NO: 3290 - DNA, 10 bp, Artificial Sequence
  intronic recognition element for splicing modifier (REMS)
ctgagtgcgc

SEQ ID NO: 3291 - DNA, 10 bp, Artificial Sequence
  intronic recognition element for splicing modifier (REMS)
gtgagtgcgc

SEQ ID NO: 3292 - DNA, 10 bp, Artificial Sequence
  intronic recognition element for splicing modifier (REMS)
ttgagtgcgc

SEQ ID NO: 3293 - DNA, 10 bp, Artificial Sequence
  intronic recognition element for splicing modifier (REMS)
  misc_feature (2)..(2): n is a, c, g, or t
angagtgggc

SEQ ID NO: 3294 - DNA, 10 bp, Artificial Sequence
  intronic recognition element for splicing modifier (REMS)
  misc_feature (1)..(1): n is a, c, g, or t
nagagtgggc

SEQ ID NO: 3295 - DNA, 10 bp, Artificial Sequence
  intronic recognition element for splicing modifier (REMS)
aagagtgggc

SEQ ID NO: 3296 - DNA, 10 bp, Artificial Sequence
  intronic recognition element for splicing modifier (REMS)
cagagtgggc

SEQ ID NO: 3297 - DNA, 10 bp, Artificial Sequence
  intronic recognition element for splicing modifier (REMS)
gagagtgggc

SEQ ID NO: 3298 - DNA, 10 bp, Artificial Sequence
  intronic recognition element for splicing modifier (REMS)
tagagtgggc

SEQ ID NO: 3299 - DNA, 10 bp, Artificial Sequence
  intronic recognition element for splicing modifier (REMS)
  misc_feature (2)..(2): n is a, c, g, or t
cngagtgggc

SEQ ID NO: 3300 - DNA, 10 bp, Artificial Sequence
  intronic recognition element for splicing modifier (REMS)
  misc_feature (1)..(1): n is a, c, g, or t
ncgagtgggc

SEQ ID NO: 3301 - DNA, 10 bp, Artificial Sequence
  intronic recognition element for splicing modifier (REMS)
acgagtgggc

SEQ ID NO: 3302 - DNA, 10 bp, Artificial Sequence
  intronic recognition element for splicing modifier (REMS)
ccgagtgggc

SEQ ID NO: 3303 - DNA, 10 bp, Artificial Sequence
  intronic recognition element for splicing modifier (REMS)
gcgagtgggc

SEQ ID NO: 3304 - DNA, 10 bp, Artificial Sequence
  intronic recognition element for splicing modifier (REMS)
tcgagtgggc

SEQ ID NO: 3305 - DNA, 10 bp, Artificial Sequence
  intronic recognition element for splicing modifier (REMS)
  misc_feature (2)..(2): n is a, c, g, or t
gngagtgggc

SEQ ID NO: 3306 - DNA, 10 bp, Artificial Sequence
  intronic recognition element for splicing modifier (REMS)
  misc_feature (1)..(1): n is a, c, g, or t
nggagtgggc

(The sequence listing continues in the following parts.)

What is claimed is:

1. A method for producing a mature mRNA transcript comprising an iExon from a pre-mRNA transcript, the method comprising contacting the pre-mRNA transcript with a compound, wherein the pre-mRNA transcript comprises two exons and an intron, wherein one exon is upstream of the intron and the other exon is downstream of the intron, wherein the intron comprises in 5' to 3' order: a first 5' splice site, a first branch point, a first 3' splice site, an endogenous intronic recognition element for splicing modifier (iREMS), a second branch point, and a second 3' splice site, wherein the iREMS comprises an RNA sequence NNGAgurngn (SEQ ID NO: 1), wherein r is adenine or guanine and n or N is any nucleotide, wherein the pre-mRNA transcript is a pre-mRNA transcript of a gene that is selected from ABCB8, ABCC3, ADAM17, ADCY3, AGPAT4, ANKRA2, ANXA11, APIP, APPL2, ARHGAP1, ARL15, ASAP1, ATAD2B, ATXN1, BECN1, BHMT2, BICD1, BTN3A1, C11orf30, C11orf73, C12orf4, C14orf132, C8orf44, C8orf44-SGK3, C8orf88, CASC3, CASP7, CCDC122, CDH13, CECR7, CENPI, CEP112, CEP192, CHEK1, CMAHP, COPS7B, CPSF4, CRISPLD2, CRYBG3, CSNK1E, CSNK1G1, DCAF17, DCUN1D4, DDX42, DENND1A, DENND5A, DGKA, DHFR, DIAPH3, DNAJC13, DNMBP, DOCK1, DYRK1A, EIF2B3, ENAH, EP300, ERC1, ERLIN2, ERRFI1, EVC, FAF1, FAIM, FAM126A, FAM13A, FAM162A, FAM174A, FBN2, FER, FHOD3, FOCAD, GALC, GCFC2, GGACT, GLCE, GOLGA4, GOLGB1, GPSM2, GULP1, GXYLT1, HDX, HLTF, HMGA2, HNMT, HSD17B12, HSD17B4, HTT, IFT57, IVD, KDM6A, KIAA1524, KIAA1715, LETM2, LOC400927, LRRC42, LUC7L3, LYRM1, MB21D2, MCM10, MED13L, MEDAG, MEMO1, MFN2, MMS19, MRPL45, MRPS28, MTERF3, MYCBP2, MYLK, MYOF, NGF, NREP, NSUN4, NT5C2, OSMR, OXCT1, PAPD4, PCM1, PDE7A, PDS5B, PDXDC1, PIGN, PIK3CD, PIK3R1, PIKFYVE, PITPNB, PLEKHA1, PLSCR1, PMS1, POMT2, PPARG, PPIP5K2, PPP1R26, PRPF31, PRSS23, PSMA4, PXK, RAF1, RAPGEF1, RARS2, RBKS, RERE, RFWD2, RPA1, RPS10, SAMD4A, SAR1A, SCO1, SEC24A, SENP6, SERGEF, SGK3, SLC12A2, SLC25A17, SLC44A2, SMYD3, SNAP23, SNHG16, SNX7, SOS2, SPATA5, SPIDR, SPRYD7, SRGAP1, SRRM1, STAT1, STXBP6, SUPT20H, TAF2, TASP1, TBC1D15, TCF12, TCF4, TIAM1, TJP2, TMC3, TMEM214, TNRC6A, TNS3, TOE1, TRAF3, TSPAN2, TTC7B, TYW5, UBAP2L, URGCP, VAV2, WDR27, WDR37, WDR91, WNK1, XRN2, ZCCHC8, ZFP82, ZNF138, ZNF232 or ZNF37BP;

and wherein the compound is selected from 2-(4,6-dimethylpyrazolo[1,5-a]pyrazin-2-yl)-7-(4-methylpiperazin-1-yl)-4H-pyrido[1,2-a]pyrimidin-4-one, 2-(4,6-dimethylpyrazolo[1,5-a]pyrazin-2-yl)-7-(1-ethylpiperidin-4-yl)-9-methyl-4H-pyrido[1,2-a]pyrimidin-4-one, and 2-(4-ethyl-6-methylpyrazolo[1,5-a]pyrazin-2-yl)-9-methyl-7-(1-methylpiperidin-4-yl)-4H-pyrido[1,2-a]pyrimidin-4-one or a salt thereof.

2. The method of claim 1, wherein
the RNA sequence NNGAgurngn (SEQ ID NO: 1) is NNGAguragu (SEQ ID NO: 3862), wherein r is adenine or guanine and N is any nucleotide.

3. The method of claim 1, wherein
the RNA sequence NNGAgurngn (SEQ ID NO: 1) is selected from the group consisting of ANGAgurngn (SEQ ID NO: 29), CNGAgurngn (SEQ ID NO: 35), GNGAgurngn (SEQ ID NO: 41), UNGAgurngn (SEQ ID NO: 47), NAGAgurngn (SEQ ID NO: 30), NCGAgurngn (SEQ ID NO: 36), NGGAgurngn (SEQ ID NO: 42), NUGAgurngn (SEQ ID NO: 48), AAGAgurngn (SEQ ID NO: 31), ACGAgurngn (SEQ ID NO: 37), AGGAgurngn (SEQ ID NO: 43), AUGAgurngn (SEQ ID NO: 49), CAGAgurngn (SEQ ID NO: 32), CCGAgurngn (SEQ ID NO: 38), CGGAgurngn (SEQ ID NO: 44), CUGAgurngn (SEQ ID NO: 50), GAGAgurngn (SEQ ID NO: 33), GCGAgurngn (SEQ ID NO: 39), GGGAgurngn (SEQ ID NO: 45), GUGAgurngn (SEQ ID NO: 51), UAGAgurngn (SEQ ID NO: 34), UCGAgurngn (SEQ ID NO: 40), UGGAgurngn (SEQ ID NO: 46) and UUGAgurngn (SEQ ID NO: 52), wherein r is adenine or guanine and n or N is any nucleotide.

4. The method of claim 1, wherein the pre-mRNA transcript is in a cell or a lysate of the cell and the method comprises contacting the cell or cell lysate with the compound.

5. The method of claim 2, wherein the RNA sequence NNGAguragu (SEQ ID NO: 3862) is selected from the group consisting of ANGAguragu (SEQ ID NO: 437), CNGAguragu (SEQ ID NO: 443), GNGAguragu (SEQ ID NO: 449), UNGAguragu (SEQ ID NO: 455), NAGAguragu (SEQ ID NO: 438), NCGAguragu (SEQ ID NO: 444), NGGAguragu (SEQ ID NO: 450), NUGAguragu (SEQ ID NO: 456), AAGAguragu (SEQ ID NO: 439), ACGAguragu (SEQ ID NO: 445), AGGAguragu (SEQ ID NO: 451), AUGAguragu (SEQ ID NO: 457), CAGAguragu (SEQ ID NO: 440), CCGAguragu (SEQ ID NO: 446), CGGAguragu (SEQ ID NO: 452), CUGAguragu (SEQ ID NO: 458), GAGAguragu (SEQ ID NO: 441), GCGAguragu (SEQ ID NO: 447), GGGAguragu (SEQ ID NO: 453), GUGAguragu (SEQ ID NO: 459), UAGAguragu (SEQ ID NO: 442), UCGAguragu (SEQ ID NO: 448), UGGAguragu (SEQ ID NO: 454) and UUGAguragu (SEQ ID NO: 460), wherein r is adenine or guanine, and N is any nucleotide.

6. The method of claim 1, wherein the compound is 2-(4,6-dimethylpyrazolo[1,5-a]pyrazin-2-yl)-7-(4-methylpiperazin-1-yl)-4H-pyrido[1,2-a]pyrimidin-4-one or a salt thereof.

7. The method of claim 1, wherein the compound is 2-(4,6-dimethylpyrazolo[1,5-a]pyrazin-2-yl)-7-(1-ethylpiperidin-4-yl)-9-methyl-4H-pyrido[1,2-a]pyrimidin-4-one or a salt thereof.

8. The method of claim 1, wherein the compound is 2-(4-ethyl-6-methylpyrazolo[1,5-a]pyrazin-2-yl)-9-methyl-7-(1-methylpiperidin-4-yl)-4H-pyrido[1,2-a]pyrimidin-4-one or a salt thereof.

9. The method of claim 1, wherein the pre-mRNA transcript is a pre-mRNA transcript of a gene that is selected from ABCC3, ADCY3, AGPAT4, ANKRA2, ANXA11, APIP, APPL2, ARHGAP1, ASAP1, ATAD2B, ATXN1, BECN1, BHMT2, BICD1, BTN3A1, C11orf30, C11orf73, C14orf132, C8orf88, CASC3, CASP7, CCDC122, CDH13, CECR7, CEP112, CMAHP, CPSF4, CRISPLD2, CRYBG3, CSNK1G1, DCAF17, DCUN1D4, DDX42, DENND1A, DENND5A, DGKA, DIAPH3, DNAJC13, DNMBP, DOCK1, DYRK1A, EIF2B3, ERC1, ERLIN2, EVC, FAF1, FAIM, FAM126A, FAM13A, FAM174A, FBN2, FER, FHOD3, FOCAD, GALC, GCFC2, GGACT, GLCE, GOLGA4, GOLGB1, GXYLT1, HLTF, HMGA2, HNMT, HSD17B12, HSD17B4, HTT, IFT57, IVD, KIAA1524, KIAA1715, LUC7L3, LYRM1, MB21D2, MCM10, MED13L, MEDAG, MEMO1, MMS19, MRPL45, MRPS28, MTERF3, MYCBP2, MYOF, NREP, NSUN4, NT5C2, OSMR, OXCT1, PAPD4, PCM1, PDS5B, PIK3R1, PIKFYVE, PITPNB, PLSCR1, PMS1, PPIP5K2, PRSS23, PSMA4, PXK, RAF1, RARS2, RFWD2, RPA1, SAMD4A, SAR1A, SCO1, SEC24A, SERGEF, SMYD3, SNAP23, SNHG16, SNX7, SPATA5, SPIDR, SPRYD7, SRGAP1, STAT1, STXBP6, SUPT20H, TAF2, TBC1D15, TCF12, TJP2, TMEM214, TNS3, TOE1, TRAF3, TSPAN2, TYW5, URGCP, XRN2, and ZNF232.

* * * * *